United States Patent 12,508,308 (INFLUENZA mRNA VACCINES) - sequence listing, part 46

SEQ ID NO: 179031 - RNA, 1755 nt, Artificial Sequence
  derived and/or modified sequence opt4 from hemagglutinin__InfluenzaB__ABO72377
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugcuucaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179032 - RNA, 1755 nt, Artificial Sequence; identical to SEQ ID NO: 178925
  derived and/or modified sequence opt4 from hemagglutinin__InfluenzaB__ABR15973

SEQ ID NO: 179033 - RNA, 1752 nt, Artificial Sequence
  derived and/or modified sequence opt4 from hemagglutinin__InfluenzaB__ABR15995
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaucacccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacuacaagacccagaugaagaaccuguacggcgacagcaacccccagaaguucaccagcagcgccaacggcaucaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179034 - RNA, 1758 nt, Artificial Sequence
  derived and/or modified sequence opt4 from hemagglutinin__InfluenzaB__ABR16017
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179035 - RNA, 1758 nt, Artificial Sequence; identical to SEQ ID NO: 179034
  derived and/or modified sequence opt4 from hemagglutinin__InfluenzaB__ACA64899

SEQ ID NO: 179036 - RNA, 1758 nt, Artificial Sequence
  derived and/or modified sequence opt4 from hemagglutinin__InfluenzaB__ACA64932
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucagcaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaucaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacaagaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179037 - RNA, 1758 nt, Artificial Sequence; identical to SEQ ID NO: 179034
  derived and/or modified sequence opt4 from hemagglutinin__InfluenzaB__ACA64943

SEQ ID NO: 179038 - RNA, 1758 nt, Artificial Sequence
  derived and/or modified sequence opt4 from hemagglutinin__InfluenzaB__ACA64954
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccagcagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179039 - RNA, 1758 nt, Artificial Sequence; identical to SEQ ID NO: 179034
  derived and/or modified sequence opt4 from hemagglutinin__InfluenzaB__ACA64965

SEQ ID NO: 179040 - RNA, 1758 nt, Artificial Sequence
  derived and/or modified sequence opt4 from hemagglutinin__InfluenzaB__ACA64998
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugcuucaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179041 - RNA, 1758 nt, Artificial Sequence
  derived and/or modified sequence opt4 from hemagglutinin__InfluenzaB__ACA65020
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucagcaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggaggugggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179042 - RNA, 1758 nt, Artificial Sequence; identical to SEQ ID NO: 179040
  derived and/or modified sequence opt4 from hemagglutinin__InfluenzaB__ACA65031

SEQ ID NO: 179043 - RNA, 1758 nt, Artificial Sequence
  derived and/or modified sequence opt4 from hemagglutinin__InfluenzaB__ACA65042
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucagcaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucaucguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179044 - RNA, 1758 nt, Artificial Sequence
  derived and/or modified sequence opt4 from hemagglutinin__InfluenzaB__ACA65053
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcaccagaaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179045 - RNA, 1758 nt, Artificial Sequence
  derived and/or modified sequence opt4 from hemagglutinin__InfluenzaB__ACA65075
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugacccuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179046 - RNA, 1758 nt, Artificial Sequence; identical to SEQ ID NO: 179034
  derived and/or modified sequence opt4 from hemagglutinin__InfluenzaB__ACA65086

SEQ ID NO: 179047 - RNA, 1758 nt, Artificial Sequence; identical to SEQ ID NO: 179034
  derived and/or modified sequence opt4 from hemagglutinin__InfluenzaB__ACA65097

SEQ ID NO: 179048 - RNA, 1758 nt, Artificial Sequence; identical to SEQ ID NO: 179034
  derived and/or modified sequence opt4 from hemagglutinin__InfluenzaB__ACA96552

SEQ ID NO: 179049 - RNA, 1758 nt, Artificial Sequence; identical to SEQ ID NO: 179034
  derived and/or modified sequence opt4 from hemagglutinin__InfluenzaB__ACA96563

SEQ ID NO: 179050 - RNA, 1758 nt, Artificial Sequence; identical to SEQ ID NO: 179034
  derived and/or modified sequence opt4 from hemagglutinin__InfluenzaB__ACA96574

SEQ ID NO: 179051 - RNA, 1758 nt, Artificial Sequence; identical to SEQ ID NO: 179034
  derived and/or modified sequence opt4 from hemagglutinin__InfluenzaB__ACA96585

SEQ ID NO: 179052 - RNA, 1758 nt, Artificial Sequence
  derived and/or modified sequence opt4 from hemagglutinin__InfluenzaB__ACA96596
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucgacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179053 - RNA, 1758 nt, Artificial Sequence; identical to SEQ ID NO: 179034
  derived and/or modified sequence opt4 from hemagglutinin__InfluenzaB__ACA96607

SEQ ID NO: 179054 - RNA, 1758 nt, Artificial Sequence
  derived and/or modified sequence opt4 from hemagglutinin__InfluenzaB__ACA96618
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucuuccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179055 - RNA, 1758 nt, Artificial Sequence; identical to SEQ ID NO: 179034
  derived and/or modified sequence opt4 from hemagglutinin__InfluenzaB__ACA96629

SEQ ID NO: 179056 - RNA, 1758 nt, Artificial Sequence; identical to SEQ ID NO: 179040
  derived and/or modified sequence opt4 from hemagglutinin__InfluenzaB__ACA96640

SEQ ID NO: 179057 - RNA, 1755 nt, Artificial Sequence
  derived and/or modified sequence opt4 from hemagglutinin__InfluenzaB__ACD56566
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugguggacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacaagaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179058 - RNA, 1755 nt, Artificial Sequence
  derived and/or modified sequence opt4 from hemagglutinin__InfluenzaB__ACD56577
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaaggcccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179059 - RNA, 1758 nt, Artificial Sequence; identical to SEQ ID NO: 179040
  derived and/or modified sequence opt4 from hemagglutinin__InfluenzaB__ACF41658

SEQ ID NO: 179060 - RNA, 1758 nt, Artificial Sequence
  derived and/or modified sequence opt4 from hemagglutinin__InfluenzaB__ACF54136
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacaagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacaucagcugcagcaucugccuguga

SEQ ID NO: 179061 - RNA, 1758 nt, Artificial Sequence; identical to SEQ ID NO: 179034
  derived and/or modified sequence opt4 from hemagglutinin__InfluenzaB__ACF54147

SEQ ID NO: 179062 - RNA, 1755 nt, Artificial Sequence
  derived and/or modified sequence opt4 from hemagglutinin__InfluenzaB__ACF54158
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcagacccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179063 - RNA, 1755 nt, Artificial Sequence
  derived and/or modified sequence opt4 from hemagglutinin__InfluenzaB__ACF54169
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccccaugaagaaccuguacggcgacagcaacccccagaaguucaccagcagcgccaacggcgugaccacccacuacgugagccagaucggcggcuuccccgcccagaccgaggacgagggcaucccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucagcaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179064 - RNA, 1755 nt, Artificial Sequence
  derived and/or modified sequence opt4 from hemagglutinin__InfluenzaB__ACF54180
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccccaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179065 - RNA, 1755 nt, Artificial Sequence
  derived and/or modified sequence opt4 from hemagglutinin__InfluenzaB__ACF54202
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcagaagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgcccagaccgaggacgagggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179066 - RNA, 1755 nt, Artificial Sequence
  derived and/or modified sequence opt4 from hemagglutinin__InfluenzaB__ACF54213
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgagaacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179067 - RNA, 1758 nt, Artificial Sequence
  derived and/or modified sequence opt4 from hemagglutinin__InfluenzaB__ACF54224
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcagcaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagagauacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179068 - RNA, 1755 nt, Artificial Sequence
  derived and/or modified sequence opt4 from hemagglutinin__InfluenzaB__ACF54257
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagagagaacaacaagaccgccaccaacccccugaccguggaggugccccacaucugcaccaaggaggaggaccagaucaccguguggggcuuccacagcgacaacaagccccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179069 - RNA, 1755 nt, Artificial Sequence
  derived and/or modified sequence opt4 from hemagglutinin__InfluenzaB__ACF54268
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagagagaacaacaagaccgccaccaacccccugaccguggaggugccccacaucugcaccaaggaggaggaccagaucaccguguggggcuuccacagcgacaacaagauccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179070 - RNA, 1755 nt, Artificial Sequence
  derived and/or modified sequence opt4 from hemagglutinin__InfluenzaB__ACF54279
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagagagaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179071 - RNA, 1755 nt, Artificial Sequence
  derived and/or modified sequence opt4 from hemagglutinin__InfluenzaB__ACF54290
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugguggacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaagaagacccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacaagaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179072 - RNA, 1758 nt, Artificial Sequence
  derived and/or modified sequence opt4 from hemagglutinin__InfluenzaB__ACF54312
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcagcaacggcgugaccacccacuacaucagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179073 - RNA, 1758 nt, Artificial Sequence
  derived and/or modified sequence opt4 from hemagglutinin__InfluenzaB__ACF54323
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcaccagaaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179074 - RNA, 1755 nt, Artificial Sequence
  derived and/or modified sequence opt4 from hemagglutinin__InfluenzaB__ACF54345
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaaggcccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugagagagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179075 - RNA, 1755 nt, Artificial Sequence
  derived and/or modified sequence opt4 from hemagglutinin__InfluenzaB__ACF54367
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccgcccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacagcaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179076 - RNA, 1755 nt, Artificial Sequence
  derived and/or modified sequence opt4 from hemagglutinin__InfluenzaB__ACN32556
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcuucgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179077 - RNA, 1758 nt, Artificial Sequence
  derived and/or modified sequence opt4 from hemagglutinin__InfluenzaB__ACN32567
auggaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179078 - RNA, 1758 nt, Artificial Sequence; identical to SEQ ID NO: 179034
  derived and/or modified sequence opt4 from hemagglutinin__InfluenzaB__ACN32578

SEQ ID NO: 179079 - RNA, 1758 nt, Artificial Sequence
  derived and/or modified sequence opt4 from hemagglutinin__InfluenzaB__ACN32589
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucagcaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179080 - RNA, 1758 nt, Artificial Sequence
  derived and/or modified sequence opt4 from hemagglutinin__InfluenzaB__ACN32600
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucagcaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccagacugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179081 - RNA, 1758 nt, Artificial Sequence; identical to SEQ ID NO: 179045
  derived and/or modified sequence opt4 from hemagglutinin__InfluenzaB__ACN32611

SEQ ID NO: 179082 - RNA, 1755 nt, Artificial Sequence; identical to SEQ ID NO: 178946
  derived and/or modified sequence opt4 from hemagglutinin__InfluenzaB__ACN32716

SEQ ID NO: 179083 - RNA, 1758 nt, Artificial Sequence; identical to SEQ ID NO: 179034
  derived and/or modified sequence opt4 from hemagglutinin__InfluenzaB__ACN32771

SEQ ID NO: 179084 - RNA, 1758 nt, Artificial Sequence; identical to SEQ ID NO: 179040
  derived and/or modified sequence opt4 from hemagglutinin__InfluenzaB__ACN32782

SEQ ID NO: 179085 - RNA, 1758 nt, Artificial Sequence
  derived and/or modified sequence opt4 from hemagglutinin__InfluenzaB__ACO05957
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179086 - RNA, 1755 nt, Artificial Sequence
  derived and/or modified sequence opt4 from hemagglutinin__InfluenzaB__ACO05968
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagagagaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179087 - RNA, 1755 nt, Artificial Sequence
  derived and/or modified sequence opt4 from hemagglutinin__InfluenzaB__ACO05979
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179088 - RNA, 1755 nt, Artificial Sequence; identical to SEQ ID NO: 179087
  derived and/or modified sequence opt4 from hemagglutinin__InfluenzaB__ACO05990

SEQ ID NO: 179089 - RNA, 1758 nt, Artificial Sequence
  derived and/or modified sequence opt4 from hemagglutinin__InfluenzaB__ACO06001
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagaaccagauggccaagcuguacggcgacagcaagccccagaaguucaccagcuucgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179090 - RNA, 1755 nt, Artificial Sequence; identical to SEQ ID NO: 179087
  derived and/or modified sequence opt4 from hemagglutinin__InfluenzaB__ACO06012

SEQ ID NO: 179091 - RNA, 1755 nt, Artificial Sequence; identical to SEQ ID NO: 179087
  derived and/or modified sequence opt4 from hemagglutinin__InfluenzaB__ACO06023

SEQ ID NO: 179092 - RNA, 1755 nt, Artificial Sequence
  derived and/or modified sequence opt4 from hemagglutinin__InfluenzaB__ACO06062
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucgacagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179093 - RNA, 1758 nt, Artificial Sequence
  derived and/or modified sequence opt4 from hemagglutinin__InfluenzaB__ACO94661
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucaccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179094 - RNA, 1758 nt, Artificial Sequence; identical to SEQ ID NO: 179034
  derived and/or modified sequence opt4 from hemagglutinin__InfluenzaB__ACR15622

SEQ ID NO: 179095 - RNA, 1758 nt, Artificial Sequence
  derived and/or modified sequence opt4 from hemagglutinin__InfluenzaB__ACR15633
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179096 - RNA, 1755 nt, Artificial Sequence
  derived and/or modified sequence opt4 from hemagglutinin__InfluenzaB__ACR15644
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179097 - RNA, 1758 nt, Artificial Sequence
  derived and/or modified sequence opt4 from hemagglutinin__InfluenzaB__ACR15655
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacaucagcugcagcaucugccuguga

SEQ ID NO: 179098 - RNA, 1758 nt, Artificial Sequence
  derived and/or modified sequence opt4 from hemagglutinin__InfluenzaB__ACR15666
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacaacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacgacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179099 - RNA, 1758 nt, Artificial Sequence
  derived and/or modified sequence opt4 from hemagglutinin__InfluenzaB__ACR15677
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacaucaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179100 - RNA, 1755 nt, Artificial Sequence; identical to SEQ ID NO: 179087
  derived and/or modified sequence opt4 from hemagglutinin__InfluenzaB__ACR15710

SEQ ID NO: 179101 - RNA, 1755 nt, Artificial Sequence
  derived and/or modified sequence opt4 from hemagglutinin__InfluenzaB__ACR15721
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacagacugggcaccagcggcagcugccccaacgccaccagcagaagcggcuucuucgccaccauggccugggccgugcccagagacgacaacaagaccgccaccaacccccugaccguggaggugcccuacgugugcaccgagggcgaggaccagaucaccguguggggcuuccacagcgacaacaaggcccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179102 - RNA, 1758 nt, Artificial Sequence
  derived and/or modified sequence opt4 from hemagglutinin__InfluenzaB__ACR39336
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179103 - RNA, 1755 nt, Artificial Sequence
  derived and/or modified sequence opt4 from hemagglutinin__InfluenzaB__AEA51386
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacuacaagaacgccaccaacccccugaccguggaggugcccuacaucugcaccgagggcgagggccagaucaccguguggggcuuccacagcgacaacaagccccagaugaagaaccuguacggcgacagcaacccccagaaguucaccagcagcgccagcggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaucaccccccagaagcuggccaacggcaccaccuucagcccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179104 - RNA, 1755 nt, Artificial Sequence
  derived and/or modified sequence opt4 from hemagglutinin__InfluenzaB__AEA51387
augaaggccaucaucgugcugcugaugguggugaccagcaacgccgacagaaucugcaccgagaucaccagcagcaacagcccccugguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggccccaucguguaccagagaggcgugcugcugccccagaagguguggugcgccagcggcagaagcaaggugaucaagggcagccugccccugaucggcgaggccgacugccugcacgagaaguacggcggccugaacaagagcaaguacagccacaccggcgaccacgccaagacccugggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179105 - RNA, 1755 nt, Artificial Sequence
  derived and/or modified sequence opt4 from hemagglutinin__InfluenzaB__AEA51388
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccagcuacaccggcgagcacgccaaggccaagggcaacugccccaucugggugaacaccccccugaagcuggccaacggcaccaaguacagaccccccgccaagcuguucaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaagggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179106 - RNA, 1755 nt, Artificial Sequence
  derived and/or modified sequence opt4 from hemagglutinin__InfluenzaB__AEA51389
augaaggccaucaucgugcugcugaugguggugaccagcaacgccgacagaaucugcaccggcaucaccagcagcaucagcccccugguggacaagaccgccacccagggcgaggugaacgugaccggcgugaucccccugaccaccacccccaccaagagcuacuucgccaacgugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgcccagaaggcccccggcggccccuacagacugggcaccagcggcagcugccccaacgccaccagcaagaucggcuucuucgccaccauggccugcgccgugcccaaggacaacuacaagaacgccaccaacccccugaccguggaggugcccuacaucagaaccgagggcgaggaccagaucaccguguggggcuuccacagcgacaacaagacccagaugaagaaccuguacggcgacagcaacccccccaaguucaccagcagcgccaacggcgugaccacccacuacgugagccagaccggcgacuuccccgaccagaccgaggacggcggccugccccccagcggcagaaucgugguggacuacaugaugcagaagcccggcaagaccggcaccaucgccuaccagagaggcgugcugcugccccagaagguguggugcgccagcggcagaagcaaggugaucaagggcagccugccccugaucggcgaggccgacugccugcacgagaaguacggcggccugaacaagagcaagcccccccacaccggcgagcacaccaaggccaucggcaacugccccaucugggugaagaccccccugaagcuggccaacggcaccaaguacagacccagcgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucuuccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179107 - RNA, 1755 nt, Artificial Sequence
  derived and/or modified sequence opt4 from hemagglutinin__InfluenzaB__AEA51390
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccccagcggcagaaucgugguggacuacaugaugcagaagcccggcaagaccggcaccaucguguaccagagaggcggccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagcccccccugaagcuggccaacggcaccaaguacagaccccccgccaagcuguucaaggagagaggcuucuucggcgcccuggccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179108 - RNA, 1758 nt, Artificial Sequence
  derived and/or modified sequence opt4 from hemagglutinin__InfluenzaB__AEA51391
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgugaacgagacccagauggccaagcuguacggcgacagcaagccccagaaguucaccagcagcgccaacggcgugaccacccacuacaucagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcgugcccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179109 - RNA, 1758 nt, Artificial Sequence
  derived and/or modified sequence opt4 from hemagglutinin__InfluenzaB__AEA51392
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcggcaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaagaacaucgcccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179110 - RNA, 1755 nt, Artificial Sequence
  derived and/or modified sequence opt4 from hemagglutinin__InfluenzaB__AEA51395
augaaggccaucaucgugcugcugaugguggugaccagcaacgccgacagaaucugcaccggcaucaccagcagcaacagcccccacguggugaagaccgccacccugggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccaguucaccguguggggcuuccacagcgacaacaucacccagcugaagaaccuguucggcgacagcaacccccagagauucaccagcagcgccaacggcgugaccacccacuacgugagccagaucggcgacuuccccgaccagaccgaggacggcggccugccccagagcggcagaaucgugguggacuacgugaugcagaagcccggcaagaccggcaccaucguguaccagagaggcgugcugcugccccccaaggugugguucgccagaggcagaagcaaggugaucaagggcagccugccccugaucggcgaggccgacugcauccacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179111 - RNA, 1758 nt, Artificial Sequence
  derived and/or modified sequence opt4 from hemagglutinin__InfluenzaB__AEA51398
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaucggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagagcuacuacaccggcgagcacgccaaggccaucggcaacugccccaucugggugaagaccccccugaagcuggccaacggcaccaaguacagaccccccgcccaccugagcuacuucugcggcuucuucggcgccaucgccggcuuccuggagggcggcugggagggcaugaucgccggcuggaacggcuacaccagccacggcgcccacggcguggccgugguggccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179112 - RNA, 1758 nt, Artificial Sequence
  derived and/or modified sequence opt4 from hemagglutinin__InfluenzaB__AEA51399
augaaggccaucaucgugcugcugaugguggugaccagcaacgccgacagaaucugcaccggcaucaccgccagccagagccccaacaucgacaagagcagcacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaucggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagagcuacuacaccggcgagcacgccaaggccaucggcaacugccccaucugggugaagaccccccugaagcuggccaacggcaccaaguacagaccccccgcccaccugagcuacuucugcggcuucuucggcgccaucgccggcuuccuggagggcggcugggagggcaugaucgccggcuggaacggcuacaccagccacggcgcccacggcguggccgugguggccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179113 - RNA, 1758 nt, Artificial Sequence
  derived and/or modified sequence opt4 from hemagglutinin__InfluenzaB__AEG21014
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugcacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaugggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugauggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179114 - RNA, 1755 nt, Artificial Sequence
  derived and/or modified sequence opt4 from hemagglutinin__InfluenzaB__AEG21015
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaacggcuucuucgccaccauggccugggccgugcccaaggacaacuacaagggcgccaccaaccccaagaccguggaggugcccuacaucugcaccgagggcgagggccagaucaccguguggggcuuccacagcgacaacaagccccagaugaagaaccuguacggcgacagcaacccccagaaguucaccagcagcgccagcggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaucaccccccagaagcuggccaacggcaccaccuucagcccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179115 - RNA, 1755 nt, Artificial Sequence
  derived and/or modified sequence opt4 from hemagglutinin__InfluenzaB__AEG21016
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagagagccaccaaccccaagaccguggaggugcccuacaucugcaccgagggcgaggaccagaucaccguguggggcuuccacagcgacaacaagccccagaugaagaaccccuacggcgacagcaacccccagaaguucaccagcagcgccagcggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179116 - RNA, 1755 nt, Artificial Sequence
  derived and/or modified sequence opt4 from hemagglutinin__InfluenzaB__AEG21017
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccagcuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179117 - RNA, 1755 nt, Artificial Sequence
  derived and/or modified sequence opt4 from hemagglutinin__InfluenzaB__AEG21018
augaaggccaucaucgugcugcugaugguggugaccagcaacgccgacagaaucugcaccggcaucaccagcagcaucagcccccugguggacaagaccgccacccagggcgaggugaacgugaccggcgugaucccccugaccaccacccccaccaagagcuacuucgccaacgugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgcccagaaggcccccggcggccccuacagacugggcaccagcggcagcugccccaacgccaccagcaagaucggcuucuucgccaccauggccugcgccgugcccaaggacaacuacaagaacgccaccaacccccugaccguggaggugcccuacaucagaaccgagggcgaggaccagaucaccguguggggcuuccacagcgacaacaagacccagaugaagaaccuguacggcgacagcaacccccccaaguucaccagcagcgccaacggcgugaccacccacuacgugagccagaccggcgacuuccccgaccagaccgaggacggcggccugccccccagcggcagaaucgugguggacuacaugaugcagaagcccggcaagaccggccccaucgccuaccagagaggcgugcugcugccccagaagguguggugcgccagcggcagaagcaaggugaucaagggcagccugccccugaucggcgaggccgacugccugcacgagaaguacggcggccugaacaagagcaaguacagccacaccggcgaccacgccaagacccugggcaacugccccaucugggugaagaccccccugaagcuggccaacggcaccaaguacagacccagcgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179118 - RNA, 1755 nt, Artificial Sequence
  derived and/or modified sequence opt4 from hemagglutinin__InfluenzaB__AEG21019
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaccggcgacuuccccgaccagaccgaggacggcggccugccccccagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccagcuacaccggcgagcacgccaaggccaucggcaacugccccaucugggugaagaccccccugaagcuggccaacggcaccaaguacagacccagcgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179119 - RNA, 1758 nt, Artificial Sequence
  derived and/or modified sequence opt4 from hemagglutinin__InfluenzaB__AEG21021
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccauccugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugagcaucgaggugcccuacaucugcaccgagggcgaggaccagaucaccguguggggcuuccacagcgacaacgagacccagauggccaagcuguacggcgacagcaagccccagaaguucaccagcagcgccaacggcguggccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccuguucggcgaggccgacugccugcacgagaaguacggcggcuucaacaagagcaagcccuacuacaccggcgagcacgccaaggccaucggcaacugccccaucugggugaagaccccccugaagcuggccaacggcaccaaguacagaccccccgccaagcuguucaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179120 - RNA, 1758 nt, Artificial Sequence
  derived and/or modified sequence opt4 from hemagglutinin__InfluenzaB__AEG21022
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaccacccccagcgccagagccagcauccugcacgaggugagacccgugaccagcggcugcuuccccauccugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugagcguggaggugcccuacaucugcaccgagggcgaggaccagaucaccguguggggcuuccacagcgacaacgagacccagauggccaagcuguacggcgacagcaagccccagaaguucaccagcagcgccaacggcguggccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagagaggcuggugcgccagcggcagaagcaaggugaucaagggcagccugccccuguucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcuguucaaggagagaggcuucuucggcgccaucgccggcuuccuggagggcggcugggagggcaugaucgccggcuggcacggcuacaccagccacggcgcccacggcgugcccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179121 - RNA, 1755 nt, Artificial Sequence
  derived and/or modified sequence opt4 from hemagglutinin__InfluenzaB__AEG21023
augaaggccaucaucgugcugcugaugguggugaccagcaacgccgacagaaucugcaccggcaucaccagcagcaacagcccccacguggugaagaccgccacccugggcgaggugaacgagaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugcccacccacuacgugagccagaucggcgacuuccccgaccccaccgaggacggcggccugccccagagcggcagaaucggcguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucagcggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugcagcgacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179122 - RNA, 1758 nt, Artificial Sequence
  derived and/or modified sequence opt4 from hemagglutinin__InfluenzaB__AEG21024
augaaggccaucaucgugcugcugaugguggugaccagcaacgccgacagaaucugcaccggcaucaccagcagcagcagcccccacguggugaagaccgccacccagggcgaggugaacgugaccggcgugaucccccugaccaccacccccaccaagagcuacuucgccaaccugaagggcaccgagaccagaggcaagcugugccccgacugccccaacugcaccgaccuggacguggcccugggcagacccaacugcuggggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaaggacgacaagaacaacgccgccacccaccugcugaccaucgaggugcccuucuucugcaccggcggcgagcaccacaucgccguguggggcuuccccagcgacaacgacacccugauggccaagcuguucggcgacagcaacccccagauguucagcagcagcgccaacggcaccaccacccacuacgugagccagaucggcggcuuccccaaccagaccgaggacggcggccugccccagagcggcagaaucgugguggacuacauggugcagaagagcggcaagaccggcaccaucgccuaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179123 - RNA, 1755 nt, Artificial Sequence
  derived and/or modified sequence opt4 from hemagglutinin__InfluenzaB__AEG21025
augaaggccaucaucgugcugcugaugguggugaccagcaacgccgacagaaucugcaccggcaucaccagcagcaacagcccccacguggugaagaccgccacccugggcgaggugaacgagaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaucaagacccagaugaagaaccuguacggcgacagcaacccccagaaguucaccagcagcgccaacggcgugcccacccacuacgugagccagaucggcgacuuccccgaccccaccgaggacggcggccugccccagagcggcagaaucggcguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucagcggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugcagcgacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179124 - RNA, 1758 nt, Artificial Sequence
  derived and/or modified sequence opt4 from hemagglutinin__InfluenzaB__AEG21026
augaaggccaugauggugcugcugaugguggugaccagcaacgccgacagaaucugcaccggcaucaccagcagcaacagcccccacguggugaagaccgccacccagggcgaggugaacgugaccggcgugaucccccugaccaucacccccaccaagagccacuucgccaaccugaaggugaaggagaccagaggcaagcugugccccaagugccccaacugcaccgaccuggacguggcccugggcagacccaagugcaccggcaagauccccagcgccagagugagcauccugcacgaggacacccccgugaccagcggcugcauccccaucaugcacgacagaaccaagaucagacagcugcccaaccugcugagaggcuacgagcacaucagacugagcacccacaacgugaucaacgccgagagcgcccccggcggccccuacaagaucggcaccagcggcagcugccccaacgugaccaacggcaucggcuucuucgccaccauggccugggccgugcccaagaacgacaagaacaagaccgccaccaacccccugaccaucgaggugcccuacaucugcaccgagggcgaggaccagaucaccguguggggcuuccacuucgacaacgagacccagauggccaagcuguacggcgacagcaagccccagguguucaccagcagcgccaacggcgugaacgccgacuucgugagccagaucagaggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaaggagagccugccccugaucggcgaggccuacuuccagcaggaggaguacggcggccugaacaagagcaagagcuacuacaccgaggagcacgccaaggccaucggcaucugccccaucugggugaagaccccccugaagcuggccaacaagaccaaguacagaccccccgcccaccugagcuacuucugcggcuucuucggcgccaucgccggcuuccuggagggcggcugggagggcaugaucgccggcuggaacggcuacaccagccacggcgcccacggcguggccgugguggccgaccugaagagcacccaggaggccaucaacaagaucaccaagaaccugaacagccugagcgagcuggagguggagacccugcagagacugagcggcgccauggacgagcugcacaacgagauccuggagcuggacgagaagguggacgaccacagagccgacaccaucagcagccagaucgagcugcccgaccagcugagcaacgacggcagcaucaacagcgaggacgagcaccugcuggcccuggagagaaagcugaagaagaugcugggccccagcaacggcgacaagggcagcggcggcaucgagaccaagcacaagugcaaccagaccugccuggacagaaucgccgccggcaccuucgacgccggcggcuucagccaccccaccuucgacagcaagaacgugaccgccgccagccugaacgacgacggccuggacagcggcaccauccugcuguacuacagcaccgacgugagcaaccuggccgugaccgugaugaugggcaucuucgugaaguacauggugagcagagacaacgugagcugcagcaucugccuguga

SEQ ID NO: 179125 - RNA, 1758 nt, Artificial Sequence
  derived and/or modified sequence opt4 from hemagglutinin__InfluenzaB__AEG21027
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaucacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaucggcuucuucgccaccauggccugggccgugcccaagaacgacaagaacaagaccgccaccaacccccugaccaucgaggugcccuacaucugcaccgagggcgaggaccagaucaccguguggggcuuccacuucgacaacgagacccagauggccaagcuguacggcgacagcaagccccagaaguucaccagcagcgccaacggcgugaacgccgacuucgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaaggagagccugccccugaucggcgaggccuacuuccagcaggaggaguacggcggccugaacaagagcaagagcuacuacaccggcgagcacgccaaggccaucggcaacugccccaucugggugaagaccccccugaagcuggccaacggcaccaaguacagaccccccgcccaccugagcuacuucugcggcuucuucggcgccaucgccggcuuccuggagggcggcugggagggcaugaucgccggcuggaacggcuacaccagccacggcgcccacggcguggccgugguggccgaccugaagagcacccaggaggccaucaacaagaucaccaagaaccugaacagccugagcgagcuggagguggagacccugcagagacugagcggcgccauggacgagcugcacaacgagauccuggagaucgacgagaagguggacgaccacagagccgacaccaucagcagccagaucgagcuggccgugcugcugagcaacgagggcaucaucaacagcgaggacgagcaccugcuggcccuggagagaaagcugaagaagaugcugggccccagcaacggcgacaagggcagcggcggcaucgagaccaagcacaagugcaaccagaccugccuggacagaaucgccgccggcaccuucgacgccggcgaguucagccugcccaccuucgacagccugaacaucaccgccgccagccugaacgacgacggccuggacagcggcaccauccugcuguacuacagcaccgacgugagcaaccuggccgugaccgugaugaugggcaucuucgugaaguacauggugagcagagacaacgugagcugcagcaucugccuguga

SEQ ID NO: 179126 - RNA, 1758 nt, Artificial Sequence
  derived and/or modified sequence opt4 from hemagglutinin__InfluenzaB__AEG21028
augaaggccaucaucgugcugcugaugguggugaccagcaacgccgacagaaucugcaccggcaucaccgccagccagagccccaacaucgacaagagcagcacccagggcgaggugaacgugagcugcgugaucccccugaccaccacccccaccaagagccacuucgccaaccugaaggugaaggagaccagaggcaagcugugccccaagugccccaacugcaccgaccuggacgugagccugggcagacccaagugcaccggcaagauccccagcgccagagugagcauccugcacgaggugagacccguggccagcggcggcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaucggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgccgccaagagacccugcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagagcuacuacaccggcgagcacgccaaggccaucggcaacugccccaucugggugaagaccccccugaagcuggccagcagaaccaugagcaagacccccgcccaccugagcuacuucugcggcuucuucggcgccaucgccggcuuccuggagggcggcugggagggcaugaucgccggcuggaacggcuacaccagccacggcgcccacggcguggccgugguggccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179127 - RNA, 1758 nt, Artificial Sequence
  derived and/or modified sequence opt4 from hemagglutinin__InfluenzaB__AEG21029
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaucggcuucuucgccaccauggccugggccgugcccaagaacgacaagaacaagaccgccaccaacccccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179128 - RNA, 1758 nt, Artificial Sequence
  derived and/or modified sequence opt4 from hemagglutinin__InfluenzaB__AEO80052
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179129 - RNA, 1758 nt, Artificial Sequence; identical to SEQ ID NO: 179034
  derived and/or modified sequence opt4 from hemagglutinin__InfluenzaB__AEO80067

SEQ ID NO: 179130 - RNA, 1755 nt, Artificial Sequence
  derived and/or modified sequence opt4 from hemagglutinin__InfluenzaB__AEO80078
augaaggagaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179131 - RNA, 1758 nt, Artificial Sequence
  derived and/or modified sequence opt4 from hemagglutinin__InfluenzaB__AEO80086
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179132 - RNA, 1755 nt, Artificial Sequence
  derived and/or modified sequence opt4 from hemagglutinin__InfluenzaB__AEO80097
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179133 - RNA, 1755 nt, Artificial Sequence; identical to SEQ ID NO: 178946
  derived and/or modified sequence opt4 from hemagglutinin__InfluenzaB__AEO80108

SEQ ID NO: 179134 - RNA, 1758 nt, Artificial Sequence; identical to SEQ ID NO: 179034
  derived and/or modified sequence opt4 from hemagglutinin__InfluenzaB__AEO80145

SEQ ID NO: 179135 - RNA, 1758 nt, Artificial Sequence; identical to SEQ ID NO: 179093
  derived and/or modified sequence opt4 from hemagglutinin__InfluenzaB__AEO80154

SEQ ID NO: 179136 - RNA, 1758 nt, Artificial Sequence
  derived and/or modified sequence opt4 from hemagglutinin__InfluenzaB__AEO80183
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaucgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179137 - RNA, 1758 nt, Artificial Sequence
  derived and/or modified sequence opt4 from hemagglutinin__InfluenzaB__AEO80194
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagaggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacaugaucagcagagacaacgugagcugcagcaucugccuguga

SEQ ID NO: 179138 - RNA, 1758 nt, Artificial Sequence; identical to SEQ ID NO: 179085
  derived and/or modified sequence opt4 from hemagglutinin__InfluenzaB__AEO80205

SEQ ID NO: 179139 - RNA, 1758 nt, Artificial Sequence; identical to SEQ ID NO: 179085
  derived and/or modified sequence opt4 from hemagglutinin__InfluenzaB__AEO80216

SEQ ID NO: 179140 - RNA, 1755 nt, Artificial Sequence
  derived and/or modified sequence opt4 from hemagglutinin__InfluenzaB__AEO80227
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179141 - RNA, 1758 nt, Artificial Sequence; identical to SEQ ID NO: 179102
  derived and/or modified sequence opt4 from hemagglutinin__InfluenzaB__AEO80238

SEQ ID NO: 179142 - RNA, 1758 nt, Artificial Sequence
  derived and/or modified sequence opt4 from hemagglutinin__InfluenzaB__AEP20178
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucagcaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179143 - RNA, 1758 nt, Artificial Sequence
  derived and/or modified sequence opt4 from hemagglutinin__InfluenzaB__AEP20189
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccgugcugcuguacuacagcaccgccgccagcagccuggccgugacccugaugaucgccaucuucgugguguacauggugagcagagacaacgugagcugcagcaucugccuguga

SEQ ID NO: 179144 - RNA, 1758 nt, Artificial Sequence; identical to SEQ ID NO: 179034
  derived and/or modified sequence opt4 from hemagglutinin__InfluenzaB__AEP20200

SEQ ID NO: 179145 - RNA, 1755 nt, Artificial Sequence; identical to SEQ ID NO: 178925
  derived and/or modified sequence opt4 from hemagglutinin__InfluenzaB__AEP20211

SEQ ID NO: 179146 - RNA, 1755 nt, Artificial Sequence
  derived and/or modified sequence opt4 from hemagglutinin__InfluenzaB__AEP20222
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugcuucaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugcccaacaucugcaccaaggaggaggaccagaucaccguguggggcuuccacagcgacaacaagacccagaugaagaaccuguacggcgaccccaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179147 - RNA, 1755 nt, Artificial Sequence; identical to SEQ ID NO: 179031
  derived and/or modified sequence opt4 from hemagglutinin__InfluenzaB__AEP20233

SEQ ID NO: 179148 - RNA, 1755 nt, Artificial Sequence
  derived and/or modified sequence opt4 from hemagglutinin__InfluenzaB__AEP20244
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugcuucaacugcaccgaccuggacguggcccugggcagacccaugugcaugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagaggcaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179149 - RNA, 1758 nt, Artificial Sequence; identical to SEQ ID NO: 178939
  derived and/or modified sequence opt4 from hemagglutinin__InfluenzaB__AEP20255

SEQ ID NO: 179150 - RNA, 1758 nt, Artificial Sequence
  derived and/or modified sequence opt4 from hemagglutinin__InfluenzaB__AEP20277
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacaagaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179151 - RNA, 1755 nt, Artificial Sequence
  derived and/or modified sequence opt4 from hemagglutinin__InfluenzaB__AEP20299
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaagaacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179152 - RNA, 1755 nt, Artificial Sequence
  derived and/or modified sequence opt4 from hemagglutinin__InfluenzaB__AEP20310
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccgcccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179153 - RNA, 1758 nt, Artificial Sequence
  derived and/or modified sequence opt4 from hemagglutinin__InfluenzaB__AEP20332
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179154 - RNA, 1755 nt, Artificial Sequence; identical to SEQ ID NO: 178946
  derived and/or modified sequence opt4 from hemagglutinin__InfluenzaB__AEP20343

SEQ ID NO: 179155 - RNA, 1755 nt, Artificial Sequence; identical to SEQ ID NO: 178946
  derived and/or modified sequence opt4 from hemagglutinin__InfluenzaB__AEP20354

SEQ ID NO: 179156 - RNA, 1755 nt, Artificial Sequence; identical to SEQ ID NO: 178946
  derived and/or modified sequence opt4 from hemagglutinin__InfluenzaB__AEP20365

SEQ ID NO: 179157 - RNA, 1755 nt, Artificial Sequence; identical to SEQ ID NO: 178946
  derived and/or modified sequence opt4 from hemagglutinin__InfluenzaB__AEP20376

SEQ ID NO: 179158 - RNA, 1758 nt, Artificial Sequence
  derived and/or modified sequence opt4 from hemagglutinin__InfluenzaB__AEP20398
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179159 - RNA, 1758 nt, Artificial Sequence; identical to SEQ ID NO: 179128
  derived and/or modified sequence opt4 from hemagglutinin__InfluenzaB__AEP20409

SEQ ID NO: 179160 - RNA, 1758 nt, Artificial Sequence; identical to SEQ ID NO: 179128
  derived and/or modified sequence opt4 from hemagglutinin__InfluenzaB__AEP20420

SEQ ID NO: 179161 - RNA, 1758 nt, Artificial Sequence; identical to SEQ ID NO: 179128
  derived and/or modified sequence opt4 from hemagglutinin__InfluenzaB__AEP20431

SEQ ID NO: 179162 - RNA, 1758 nt, Artificial Sequence; identical to SEQ ID NO: 179128
  derived and/or modified sequence opt4 from hemagglutinin__InfluenzaB__AEP20442

SEQ ID NO: 179163 - RNA, 1758 nt, Artificial Sequence; identical to SEQ ID NO: 179128
  derived and/or modified sequence opt4 from hemagglutinin__InfluenzaB__AEP20453

SEQ ID NO: 179164 - RNA, 1755 nt, Artificial Sequence; identical to SEQ ID NO: 178946
  derived and/or modified sequence opt4 from hemagglutinin__InfluenzaB__AEQ39027

SEQ ID NO: 179165 - RNA, 1758 nt, Artificial Sequence
  derived and/or modified sequence opt4 from hemagglutinin__InfluenzaB__AEQ39260
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179166 - RNA, 1758 nt, Artificial Sequence; identical to SEQ ID NO: 179165
  derived and/or modified sequence opt4 from hemagglutinin__InfluenzaB__AEQ39271

SEQ ID NO: 179167 - RNA, 1758 nt, Artificial Sequence
  derived and/or modified sequence opt4 from hemagglutinin__InfluenzaB__AEQ39282
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacggcgacgagcuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179168 - RNA, 1758 nt, Artificial Sequence
  derived and/or modified sequence opt4 from hemagglutinin__InfluenzaB__AEQ39315
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacggcgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179169 - RNA, 1758 nt, Artificial Sequence; identical to SEQ ID NO: 179168
  derived and/or modified sequence opt4 from hemagglutinin__InfluenzaB__AEQ39326

SEQ ID NO: 179170 - RNA, 1758 nt, Artificial Sequence
  derived and/or modified sequence opt4 from hemagglutinin__InfluenzaB__AEQ39337
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccggcaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaagccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179171 - RNA, 1758 nt, Artificial Sequence
  derived and/or modified sequence opt4 from hemagglutinin__InfluenzaB__AEQ39348
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaucauccugcuguacuacagcaccgccgccagcagccuggccgugacccugaugaucgccaucuucgugguguacauggugagcagagacaacgugagcugcagcaucugccuguga

SEQ ID NO: 179172 - RNA, 1758 nt, Artificial Sequence; identical to SEQ ID NO: 179168
  derived and/or modified sequence opt4 from hemagglutinin__InfluenzaB__AEQ39359

SEQ ID NO: 179173 - RNA, 1758 nt, Artificial Sequence
  derived and/or modified sequence opt4 from hemagglutinin__InfluenzaB__AEQ39370
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacguggugaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179174 - RNA, 1755 nt, Artificial Sequence; identical to SEQ ID NO: 178946
  derived and/or modified sequence opt4 from hemagglutinin__InfluenzaB__AEQ39392

SEQ ID NO: 179175 - RNA, 1755 nt, Artificial Sequence; identical to SEQ ID NO: 178946
  derived and/or modified sequence opt4 from hemagglutinin__InfluenzaB__AEQ39429

SEQ ID NO: 179176 - RNA, 1755 nt, Artificial Sequence; identical to SEQ ID NO: 178946
  derived and/or modified sequence opt4 from hemagglutinin__InfluenzaB__AEQ39440

SEQ ID NO: 179177 - RNA, 1755 nt, Artificial Sequence; identical to SEQ ID NO: 178946
  derived and/or modified sequence opt4 from hemagglutinin__InfluenzaB__AEQ39451

SEQ ID NO: 179178 - RNA, 1758 nt, Artificial Sequence; identical to SEQ ID NO: 179158
  derived and/or modified sequence opt4 from hemagglutinin__InfluenzaB__AEQ39462

SEQ ID NO: 179179 - RNA, 1758 nt, Artificial Sequence; identical to SEQ ID NO: 179165
  derived and/or modified sequence opt4 from hemagglutinin__InfluenzaB__AEQ39484

SEQ ID NO: 179180 - RNA, 1755 nt, Artificial Sequence; identical to SEQ ID NO: 178925
  derived and/or modified sequence opt4 from hemagglutinin__InfluenzaB__AEQ39506

SEQ ID NO: 179181 - RNA, 1758 nt, Artificial Sequence
  derived and/or modified sequence opt4 from hemagglutinin__InfluenzaB__AEQ39517
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacaacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179182 - RNA, 1758 nt, Artificial Sequence
  derived and/or modified sequence opt4 from hemagglutinin__InfluenzaB__AER27038
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccaagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcaucgccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179183 - RNA, 1758 nt, Artificial Sequence; identical to SEQ ID NO: 179128
  derived and/or modified sequence opt4 from hemagglutinin__InfluenzaB__AER27060

SEQ ID NO: 179184 - RNA, 1758 nt, Artificial Sequence
  derived and/or modified sequence opt4 from hemagglutinin__InfluenzaB__AET10061
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccaagaacgcccccggcggccccuacaagaucggcaccagcggcagcugccccaacgugaccaacggcaacggcuucuucgccaccauggccugggccgugcccaagaacgacaagaacagaaccgccaccaacagccugaccaucgaggugcccuacaucugcaaggagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179185 - RNA, 1755 nt, Artificial Sequence
  derived and/or modified sequence opt4 from hemagglutinin__InfluenzaB__AET10062
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaucacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179186 - RNA, 1755 nt, Artificial Sequence
  derived and/or modified sequence opt4 from hemagglutinin__InfluenzaB__AET10064
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccaucuggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179187 - RNA, 1755 nt, Artificial Sequence
  derived and/or modified sequence opt4 from hemagglutinin__InfluenzaB__AET10065
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179188 - RNA, 1755 nt, Artificial Sequence; identical to SEQ ID NO: 179187
  derived and/or modified sequence opt4 from hemagglutinin__InfluenzaB__AET10066

SEQ ID NO: 179189 - RNA, 1755 nt, Artificial Sequence
  derived and/or modified sequence opt4 from hemagglutinin__InfluenzaB__AET10067
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccgccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179190 - RNA, 1755 nt, Artificial Sequence
  derived and/or modified sequence opt4 from hemagglutinin__InfluenzaB__AET10068
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccgcccccaccaagagcuacuucgccaaccugaagggcaccagaaccagaggcaagcugugccccgacugccugaacugcaccgaccuggacguggcccugggcagacccaugugcgccggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179191 - RNA, 1755 nt, Artificial Sequence; identical to SEQ ID NO: 179187
  derived and/or modified sequence opt4 from hemagglutinin__InfluenzaB__AET10069

SEQ ID NO: 179192 - RNA, 1758 nt, Artificial Sequence
  derived and/or modified sequence opt4 from hemagglutinin__InfluenzaB__AET10070
augaaggccaucaucgugcugcugaugguggugaccagcaacgccgacagaaucugcaccggcaucaccagcagcaacagcccccacguggugaagaccgccacccagggcgaggugaaggugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179193 - RNA, 1758 nt, Artificial Sequence; identical to SEQ ID NO: 179128
  derived and/or modified sequence opt4 from hemagglutinin__InfluenzaB__AET10071

SEQ ID NO: 179194 - RNA, 1758 nt, Artificial Sequence; identical to SEQ ID NO: 179128
  derived and/or modified sequence opt4 from hemagglutinin__InfluenzaB__AET10072

SEQ ID NO: 179195 - RNA, 1755 nt, Artificial Sequence
  derived and/or modified sequence opt4 from hemagglutinin__InfluenzaB__AET10073
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcugcgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179196 - RNA, 1758 nt, Artificial Sequence
  derived and/or modified sequence opt4 from hemagglutinin__InfluenzaB__AET10074
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccagaagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcagaaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccuggacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179197 - RNA, 1758 nt, Artificial Sequence; identical to SEQ ID NO: 179128
  derived and/or modified sequence opt4 from hemagglutinin__InfluenzaB__AET10076

SEQ ID NO: 179198 - RNA, 1758 nt, Artificial Sequence; identical to SEQ ID NO: 179128
  derived and/or modified sequence opt4 from hemagglutinin__InfluenzaB__AET10077

SEQ ID NO: 179199 - RNA, 1758 nt, Artificial Sequence
  derived and/or modified sequence opt4 from hemagglutinin__InfluenzaB__AET10078
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcgugcugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgaggacggccuggacaaccacgccauccugcuguacuacagcaccgccgccagcagccuggccgugacccugaugaucgccaucuucgugguguacauggugagcagagacaacgugagcugcagcaucugccuguga

SEQ ID NO: 179200 - RNA, 1758 nt, Artificial Sequence
  derived and/or modified sequence opt4 from hemagglutinin__InfluenzaB__AET10079
augaaggccaucaucgugcugcugaugguggugaccagcaacgccgacggcaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucaccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggagguggagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179201 - RNA, 1758 nt, Artificial Sequence; identical to SEQ ID NO: 179128
  derived and/or modified sequence opt4 from hemagglutinin__InfluenzaB__AET10080

SEQ ID NO: 179202 - RNA, 1758 nt, Artificial Sequence; identical to SEQ ID NO: 179128
  derived and/or modified sequence opt4 from hemagglutinin__InfluenzaB__AET10081

SEQ ID NO: 179203 - RNA, 1758 nt, Artificial Sequence
  derived and/or modified sequence opt4 from hemagglutinin__InfluenzaB__AET10082
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179204 - RNA, 1758 nt, Artificial Sequence
  derived and/or modified sequence opt4 from hemagglutinin__InfluenzaB__AET10083
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaaggugcccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179205 - RNA, 1758 nt, Artificial Sequence; identical to SEQ ID NO: 179165
  derived and/or modified sequence opt4 from hemagglutinin__InfluenzaB__AET10084

SEQ ID NO: 179206 - RNA, 1758 nt, Artificial Sequence; identical to SEQ ID NO: 179128
  derived and/or modified sequence opt4 from hemagglutinin__InfluenzaB__AET10085

SEQ ID NO: 179207 - RNA, 1758 nt, Artificial Sequence; identical to SEQ ID NO: 179168
  derived and/or modified sequence opt4 from hemagglutinin__InfluenzaB__AET43124

SEQ ID NO: 179208 - RNA, 1758 nt, Artificial Sequence; identical to SEQ ID NO: 179168
  derived and/or modified sequence opt4 from hemagglutinin__InfluenzaB__AET43135

SEQ ID NO: 179209 - RNA, 1758 nt, Artificial Sequence; identical to SEQ ID NO: 179168
  derived and/or modified sequence opt4 from hemagglutinin__InfluenzaB__AET43146

SEQ ID NO: 179210 - RNA, 1758 nt, Artificial Sequence; identical to SEQ ID NO: 179168
  derived and/or modified sequence opt4 from hemagglutinin__InfluenzaB__AET43157

SEQ ID NO: 179211 - RNA, 1758 nt, Artificial Sequence
  derived and/or modified sequence opt4 from hemagglutinin__InfluenzaB__AET43168
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacgugacccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179212 - RNA, 1758 nt, Artificial Sequence; identical to SEQ ID NO: 179168
  derived and/or modified sequence opt4 from hemagglutinin__InfluenzaB__AET43179

SEQ ID NO: 179213 - RNA, 1758 nt, Artificial Sequence; identical to SEQ ID NO: 179168
  derived and/or modified sequence opt4 from hemagglutinin__InfluenzaB__AET43190

SEQ ID NO: 179214 - RNA, 1758 nt, Artificial Sequence
  derived and/or modified sequence opt4 from hemagglutinin__InfluenzaB__AET43201
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccggcaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179215 - RNA, 1758 nt, Artificial Sequence; identical to SEQ ID NO: 179168
  derived and/or modified sequence opt4 from hemagglutinin__InfluenzaB__AET43212

SEQ ID NO: 179216 - RNA, 1758 nt, Artificial Sequence; identical to SEQ ID NO: 179168
  derived and/or modified sequence opt4 from hemagglutinin__InfluenzaB__AET43223

SEQ ID NO: 179217 - RNA, 1758 nt, Artificial Sequence; identical to SEQ ID NO: 179214
  derived and/or modified sequence opt4 from hemagglutinin__InfluenzaB__AET50943

SEQ ID NO: 179218 - RNA, 1758 nt, Artificial Sequence; identical to SEQ ID NO: 179168
  derived and/or modified sequence opt4 from hemagglutinin__InfluenzaB__AET50954

SEQ ID NO: 179219 - RNA, 1758 nt, Artificial Sequence; identical to SEQ ID NO: 179168
  derived and/or modified sequence opt4 from hemagglutinin__InfluenzaB__AET50965

SEQ ID NO: 179220 - RNA, 1758 nt, Artificial Sequence; identical to SEQ ID NO: 179168
  derived and/or modified sequence opt4 from hemagglutinin__InfluenzaB__AET50976

SEQ ID NO: 179221 - RNA, 1758 nt, Artificial Sequence; identical to SEQ ID NO: 179168
  derived and/or modified sequence opt4 from hemagglutinin__InfluenzaB__AET74255

SEQ ID NO: 179222 - RNA, 1758 nt, Artificial Sequence; identical to SEQ ID NO: 179214
  derived and/or modified sequence opt4 from hemagglutinin__InfluenzaB__AET74277

SEQ ID NO: 179223 - RNA, 1758 nt, Artificial Sequence; identical to SEQ ID NO: 179168
  derived and/or modified sequence opt4 from hemagglutinin__InfluenzaB__AET74288

SEQ ID NO: 179224 - RNA, 1758 nt, Artificial Sequence
  derived and/or modified sequence opt4 from hemagglutinin__InfluenzaB__AET74299
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacgugacccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaacaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179225 - RNA, 1758 nt, Artificial Sequence; identical to SEQ ID NO: 179168
  derived and/or modified sequence opt4 from hemagglutinin__InfluenzaB__AET74329

SEQ ID NO: 179226 - RNA, 1758 nt, Artificial Sequence; identical to SEQ ID NO: 179168
  derived and/or modified sequence opt4 from hemagglutinin__InfluenzaB__AET74340

SEQ ID NO: 179227 - RNA, 1758 nt, Artificial Sequence; identical to SEQ ID NO: 179168
  derived and/or modified sequence opt4 from hemagglutinin__InfluenzaB__AET74351

SEQ ID NO: 179228 - RNA, 1758 nt, Artificial Sequence; identical to SEQ ID NO: 179165
  derived and/or modified sequence opt4 from hemagglutinin__InfluenzaB__AEY69077

SEQ ID NO: 179229 - RNA, 1758 nt, Artificial Sequence; identical to SEQ ID NO: 179165
  derived and/or modified sequence opt4 from hemagglutinin__InfluenzaB__AFB77676

SEQ ID NO: 179230 - RNA, 1758 nt, Artificial Sequence
  derived and/or modified sequence opt4 from hemagglutinin__InfluenzaB__AFB77677
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugcuucaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179231 - RNA, 1758 nt, Artificial Sequence; identical to SEQ ID NO: 179165
  derived and/or modified sequence opt4 from hemagglutinin__InfluenzaB__AFB77678

SEQ ID NO: 179232 - RNA, 1758 nt, Artificial Sequence; identical to SEQ ID NO: 179165
  derived and/or modified sequence opt4 from hemagglutinin__InfluenzaB__AFB77679

SEQ ID NO: 179233 - RNA, 1758 nt, Artificial Sequence
  derived and/or modified sequence opt4 from hemagglutinin__InfluenzaB__AFB77680
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccaucaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179234 - RNA, 1758 nt, Artificial Sequence; identical to SEQ ID NO: 179165
  derived and/or modified sequence opt4 from hemagglutinin__InfluenzaB__AFB77681

SEQ ID NO: 179235 - RNA, 1758 nt, Artificial Sequence
  derived and/or modified sequence opt4 from hemagglutinin__InfluenzaB__AFB77682
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucacccagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179236 - RNA, 1758 nt, Artificial Sequence; identical to SEQ ID NO: 179165
  derived and/or modified sequence opt4 from hemagglutinin__InfluenzaB__AFB77683

SEQ ID NO: 179237 - RNA, 1758 nt, Artificial Sequence; identical to SEQ ID NO: 179165
  derived and/or modified sequence opt4 from hemagglutinin__InfluenzaB__AFB77684

SEQ ID NO: 179238 - RNA, 1758 nt, Artificial Sequence
  derived and/or modified sequence opt4 from hemagglutinin__InfluenzaB__AFB77685
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagacccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacaucagccagaucggcggcuuccccaaccagaccgaggacggcggccugccccagagcggcagaaucgugguggacuacauggugcagaagagcgagaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179239 - RNA, 1758 nt, Artificial Sequence
  derived and/or modified sequence opt4 from hemagglutinin__InfluenzaB__AFB77686
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucagcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucacccagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179240 - RNA, 1758 nt, Artificial Sequence
  derived and/or modified sequence opt4 from hemagglutinin__InfluenzaB__AFB77687
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucaagcugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179241 - RNA, 1758 nt, Artificial Sequence
  derived and/or modified sequence opt4 from hemagglutinin__InfluenzaB__AFB77688
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaaggccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179242 - RNA, 1758 nt, Artificial Sequence; identical to SEQ ID NO: 179165
  derived and/or modified sequence opt4 from hemagglutinin__InfluenzaB__AFB77689

SEQ ID NO: 179243 - RNA, 1758 nt, Artificial Sequence; identical to SEQ ID NO: 179165
  derived and/or modified sequence opt4 from hemagglutinin__InfluenzaB__AFB77690

SEQ ID NO: 179244 - RNA, 1758 nt, Artificial Sequence; identical to SEQ ID NO: 179203
  derived and/or modified sequence opt4 from hemagglutinin__InfluenzaB__AFE00360

SEQ ID NO: 179245 - RNA, 1758 nt, Artificial Sequence; identical to SEQ ID NO: 179203
  derived and/or modified sequence opt4 from hemagglutinin__InfluenzaB__AFF18534

SEQ ID NO: 179246 - RNA, 1758 nt, Artificial Sequence; identical to SEQ ID NO: 179203
  derived and/or modified sequence opt4 from hemagglutinin__InfluenzaB__AFF18543

SEQ ID NO: 179247 - RNA, 1758 nt, Artificial Sequence; identical to SEQ ID NO: 179165
  derived and/or modified sequence opt4 from hemagglutinin__InfluenzaB__AFG48978

SEQ ID NO: 179248 - RNA, 1758 nt, Artificial Sequence; identical to SEQ ID NO: 179165
  derived and/or modified sequence opt4 from hemagglutinin__InfluenzaB__AFG48997

SEQ ID NO: 179249 - RNA, 1758 nt, Artificial Sequence
  derived and/or modified sequence opt4 from hemagglutinin__InfluenzaB__AFG48998
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgagaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179250 - RNA, 1755 nt, Artificial Sequence
  derived and/or modified sequence opt4 from hemagglutinin__InfluenzaB__AFG49012
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccagcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179251 - RNA, 1755 nt, Artificial Sequence
  derived and/or modified sequence opt4 from hemagglutinin__InfluenzaB__AFG49013
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179252 - RNA, 1755 nt, Artificial Sequence
  derived and/or modified sequence opt4 from hemagglutinin__InfluenzaB__AFH57865
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccccaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179253 - RNA, 1755 nt, Artificial Sequence
  derived and/or modified sequence opt4 from hemagglutinin__InfluenzaB__AFH57876
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagaaccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179254 - RNA, 1755 nt, Artificial Sequence
  derived and/or modified sequence opt4 from hemagglutinin__InfluenzaB__AFH57942
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagaaccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179255 - RNA, 1752 nt, Artificial Sequence
  derived and/or modified sequence opt4 from hemagglutinin__InfluenzaB__AFH57986
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagagagcccccggcggccccuacagacugggcaccagcggcagcugccccaacgugaccagcagagacggcuucuucgccaccauggccugggccgugcccagagacaacaagaccgccaccaacccccugaccguggaggugcccuacaucugcaccaagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179256 - RNA, 1758 nt, Artificial Sequence
  derived and/or modified sequence opt4 from hemagglutinin__InfluenzaB__AFH58249
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacaucccccccgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgaggaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccacccugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179257 - RNA, 1758 nt, Artificial Sequence
  derived and/or modified sequence opt4 from hemagglutinin__InfluenzaB__AFH58260
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcagcaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagagauacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179258 - RNA, 1755 nt, Artificial Sequence
  derived and/or modified sequence opt4 from hemagglutinin__InfluenzaB__AFH58271
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugaagcccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179259 - RNA, 1755 nt, Artificial Sequence; identical to SEQ ID NO: 179258
  derived and/or modified sequence opt4 from hemagglutinin__InfluenzaB__AFH58282

SEQ ID NO: 179260 - RNA, 1758 nt, Artificial Sequence
  derived and/or modified sequence opt4 from hemagglutinin__InfluenzaB__AFH58293
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacgacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179261 - RNA, 1755 nt, Artificial Sequence
  derived and/or modified sequence opt4 from hemagglutinin__InfluenzaB__AFH58304
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179262 - RNA, 1755 nt, Artificial Sequence; identical to SEQ ID NO: 179261
  derived and/or modified sequence opt4 from hemagglutinin__InfluenzaB__AFH58315

SEQ ID NO: 179263 - RNA, 1755 nt, Artificial Sequence
  derived and/or modified sequence opt4 from hemagglutinin__InfluenzaB__AFH58326
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaaggcccagaugaagaaccuguacggcgacagcaacccccagaaguucaccagcagcgccaacggcgugaccacccacuacgugagccagaucggcgacuuccccgaccagaccgaggacggcggccccccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179264 - RNA, 1755 nt, Artificial Sequence
  derived and/or modified sequence opt4 from hemagglutinin__InfluenzaB__AFH58337
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaaggcccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179265 - RNA, 1758 nt, Artificial Sequence
  derived and/or modified sequence opt4 from hemagglutinin__InfluenzaB__AFH58348
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcgcccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaaggagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179266 - RNA, 1758 nt, Artificial Sequence
  derived and/or modified sequence opt4 from hemagglutinin__InfluenzaB__AFH58370
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcgcccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179267 - RNA, 1758 nt, Artificial Sequence
  derived and/or modified sequence opt4 from hemagglutinin__InfluenzaB__AFH58392
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179268 - RNA, 1758 nt, Artificial Sequence; identical to SEQ ID NO: 179260
  derived and/or modified sequence opt4 from hemagglutinin__InfluenzaB__AFH58403

SEQ ID NO: 179269 - RNA, 1758 nt, Artificial Sequence; identical to SEQ ID NO: 179260
  derived and/or modified sequence opt4 from hemagglutinin__InfluenzaB__AFH58414

SEQ ID NO: 179270 - RNA, 1758 nt, Artificial Sequence; identical to SEQ ID NO: 179260
  derived and/or modified sequence opt4 from hemagglutinin__InfluenzaB__AFH58425

SEQ ID NO: 179271 - RNA, 1758 nt, Artificial Sequence; identical to SEQ ID NO: 179260
  derived and/or modified sequence opt4 from hemagglutinin__InfluenzaB__AFH58436

SEQ ID NO: 179272 - RNA, 1758 nt, Artificial Sequence
  derived and/or modified sequence opt4 from hemagglutinin__InfluenzaB__AFH58458
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcaccaacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagauccagauggccaagcuguacggcgacagcagaccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179273 - RNA, 1758 nt, Artificial Sequence; identical to SEQ ID NO: 179272
  derived and/or modified sequence opt4 from hemagglutinin__InfluenzaB__AFH58469

SEQ ID NO: 179274 - RNA, 1755 nt, Artificial Sequence; identical to SEQ ID NO: 179254
  derived and/or modified sequence opt4 from hemagglutinin__InfluenzaB__AFH58480

SEQ ID NO: 179275 - RNA, 1755 nt, Artificial Sequence
  derived and/or modified sequence opt4 from hemagglutinin__InfluenzaB__AFH58502
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacgacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179276 - RNA, 1758 nt, Artificial Sequence
  derived and/or modified sequence opt4 from hemagglutinin__InfluenzaB__AFH58513
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacgacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179277 - RNA, 1758 nt, Artificial Sequence; identical to SEQ ID NO: 179276
  derived and/or modified sequence opt4 from hemagglutinin__InfluenzaB__AFH58524

SEQ ID NO: 179278 - RNA, 1755 nt, Artificial Sequence
  derived and/or modified sequence opt4 from hemagglutinin__InfluenzaB__AFH58535
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcacccagaccagaggcaagcugugccccaacugcuucaacugcaccgaccuggacguggcccugggcagacccaagugcaugggcaacacccccagcgccaaggugagcauccugcacgaggugaagcccgccaccagcggcugcuuccccaucaugcacgacagaaccaagaucagacagcugcccaaccugcugagaggcuacgagaacaucagacugagcaccagcaacgugaucaacaccgagaccgcccccggcggccccuacaaggugggcaccagcggcagcugccccaacguggccaacggcaacggcuucuucaacaccauggccugggugauccccaaggacaacaacaagaccgccaucaaccccgugaccguggaggugcccuacaucugcagcgagggcgaggaccagaucaccguguggggcuuccacagcgacgacaagacccagauggagagacuguacggcgacagcaacccccagaaguucaccagcagcgccaacggcgugaccacccacuacgugagccagaucggcggcuuccccaaccagaccgaggacgagggccugaagcagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacuaccugagcgagcuggaggugaagaaccugcagagacugagcggcgccaugaacgagcugcacgacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgacuucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179279 - RNA, 1752 nt, Artificial Sequence
  derived and/or modified sequence opt4 from hemagglutinin__InfluenzaB__AFH58557
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagagagcccccggcggccccuacagacugggcaccagcggcagcugccccaacgugaccagcagagacggcuucuucgccaccauggccugggccgugcccagagacaacaagaccgccaccaacccccugaccguggaggugcccuacaucugcaccaagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagcuuccccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179280 - RNA, 1755 nt, Artificial Sequence
  derived and/or modified sequence opt4 from hemagglutinin__InfluenzaB__AFJ76224
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagccccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacaucgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179281 - RNA, 1755 nt, Artificial Sequence
  derived and/or modified sequence opt4 from hemagglutinin__InfluenzaB__AFJ76235
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagccccaugugcgugggcaucacccccagcgccaaggccagcauccugcacgaggugagacccgugaccagcagaugcuuccccaucaugcacgacagaaccaagaucagacagcugcccaaccugcugagaggcuacgagaagaucagacugagcacccagaacgugaucaacaucgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179282 - RNA, 1755 nt, Artificial Sequence; identical to SEQ ID NO: 179280
  derived and/or modified sequence opt4 from hemagglutinin__InfluenzaB__AFJ76246

SEQ ID NO: 179283 - RNA, 1758 nt, Artificial Sequence; identical to SEQ ID NO: 179034
  derived and/or modified sequence opt4 from hemagglutinin__InfluenzaB__AFJ76268

SEQ ID NO: 179284 - RNA, 1758 nt, Artificial Sequence; identical to SEQ ID NO: 179085
  derived and/or modified sequence opt4 from hemagglutinin__InfluenzaB__AFJ76301

SEQ ID NO: 179285 - RNA, 1755 nt, Artificial Sequence; identical to SEQ ID NO: 178946
  derived and/or modified sequence opt4 from hemagglutinin__InfluenzaB__AFJ76323

SEQ ID NO: 179286 - RNA, 1758 nt, Artificial Sequence
  derived and/or modified sequence opt4 from hemagglutinin__InfluenzaB__AFJ76334
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcuggaagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccguguucgugguguacauggugagcagagacaacgugagcugcagcaucugccuguga

SEQ ID NO: 179287 - RNA, 1758 nt, Artificial Sequence; identical to SEQ ID NO: 179034
  derived and/or modified sequence opt4 from hemagglutinin__InfluenzaB__AFJ77327

SEQ ID NO: 179288 - RNA, 1755 nt, Artificial Sequence; identical to SEQ ID NO: 178946
  derived and/or modified sequence opt4 from hemagglutinin__InfluenzaB__AFJ77369

SEQ ID NO: 179289 - RNA, 1755 nt, Artificial Sequence; identical to SEQ ID NO: 178946
  derived and/or modified sequence opt4 from hemagglutinin__InfluenzaB__AFJ77380

SEQ ID NO: 179290 - RNA, 1755 nt, Artificial Sequence
  derived and/or modified sequence opt4 from hemagglutinin__InfluenzaB__AFJ80139
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcuuccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179291 - RNA, 1755 nt, Artificial Sequence
  derived and/or modified sequence opt4 from hemagglutinin__InfluenzaB__AFJ80150
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179292 - RNA, 1755 nt, Artificial Sequence
  derived and/or modified sequence opt4 from hemagglutinin__InfluenzaB__AFJ80161
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucuucagagacaacgugagcugcagcaucugccuguga

SEQ ID NO: 179293 - RNA, 1755 nt, Artificial Sequence
  derived and/or modified sequence opt4 from hemagglutinin__InfluenzaB__AFJ80172
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179294 - RNA, 1755 nt, Artificial Sequence; identical to SEQ ID NO: 179280
  derived and/or modified sequence opt4 from hemagglutinin__InfluenzaB__AFJ80183

SEQ ID NO: 179295 - RNA, 1755 nt, Artificial Sequence; identical to SEQ ID NO: 179291
  derived and/or modified sequence opt4 from hemagglutinin__InfluenzaB__AFJ80194

SEQ ID NO: 179296 - RNA, 1755 nt, Artificial Sequence; identical to SEQ ID NO: 179280
  derived and/or modified sequence opt4 from hemagglutinin__InfluenzaB__AFJ80205

SEQ ID NO: 179297 - RNA, 1755 nt, Artificial Sequence; identical to SEQ ID NO: 178925
  derived and/or modified sequence opt4 from hemagglutinin__InfluenzaB__AFJ80216

SEQ ID NO: 179298 - RNA, 1755 nt, Artificial Sequence; identical to SEQ ID NO: 179280
  derived and/or modified sequence opt4 from hemagglutinin__InfluenzaB__AFJ80227

SEQ ID NO: 179299 - RNA, 1758 nt, Artificial Sequence
  derived and/or modified sequence opt4 from hemagglutinin__InfluenzaB__AFJ80238
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcauccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179300 - RNA, 1755 nt, Artificial Sequence
  derived and/or modified sequence opt4 from hemagglutinin__InfluenzaB__AFJ80656
augaaggccaucaucgugcugcugaugguggugaccagcaacgccgacagaaucugcaccggcaucaccagcagcaacagcccccacguggugagaaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179301 - RNA, 1755 nt, Artificial Sequence; identical to SEQ ID NO: 179280
  derived and/or modified sequence opt4 from hemagglutinin__InfluenzaB__AFJ80667

SEQ ID NO: 179302 - RNA, 1755 nt, Artificial Sequence; identical to SEQ ID NO: 179280
  derived and/or modified sequence opt4 from hemagglutinin__InfluenzaB__AFJ80678

SEQ ID NO: 179303 - RNA, 1755 nt, Artificial Sequence; identical to SEQ ID NO: 179280
  derived and/or modified sequence opt4 from hemagglutinin__InfluenzaB__AFJ80689

SEQ ID NO: 179304 - RNA, 1755 nt, Artificial Sequence
  derived and/or modified sequence opt4 from hemagglutinin__InfluenzaB__AFJ80711
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaucaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179305 - RNA, 1755 nt, Artificial Sequence; identical to SEQ ID NO: 179304
  derived and/or modified sequence opt4 from hemagglutinin__InfluenzaB__AFJ80722

SEQ ID NO: 179306 - RNA, 1755 nt, Artificial Sequence
  derived and/or modified sequence opt4 from hemagglutinin__InfluenzaB__AFJ80733
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcaugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccgacgccaccaacaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179307 - RNA, 1758 nt, Artificial Sequence; identical to SEQ ID NO: 179034
  derived and/or modified sequence opt4 from hemagglutinin__InfluenzaB__AFJ80744

SEQ ID NO: 179308 - RNA, 1758 nt, Artificial Sequence; identical to SEQ ID NO: 179034
  derived and/or modified sequence opt4 from hemagglutinin__InfluenzaB__AFJ80755

SEQ ID NO: 179309 - RNA, 1758 nt, Artificial Sequence; identical to SEQ ID NO: 179034
  derived and/or modified sequence opt4 from hemagglutinin__InfluenzaB__AFJ80781

SEQ ID NO: 179310 - RNA, 1758 nt, Artificial Sequence; identical to SEQ ID NO: 179034
  derived and/or modified sequence opt4 from hemagglutinin__InfluenzaB__AFJ80792

SEQ ID NO: 179311 - RNA, 1758 nt, Artificial Sequence; identical to SEQ ID NO: 179034
  derived and/or modified sequence opt4 from hemagglutinin__InfluenzaB__AFJ80803

SEQ ID NO: 179312 - RNA, 1758 nt, Artificial Sequence; identical to SEQ ID NO: 179034
  derived and/or modified sequence opt4 from hemagglutinin__InfluenzaB__AFJ80814

SEQ ID NO: 179313 - RNA, 1758 nt, Artificial Sequence
  derived and/or modified sequence opt4 from hemagglutinin__InfluenzaB__AFJ80825
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccaucaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179314 - RNA, 1758 nt, Artificial Sequence; identical to SEQ ID NO: 179034
  derived and/or modified sequence opt4 from hemagglutinin__InfluenzaB__AFJ80836

SEQ ID NO: 179315 - RNA, 1758 nt, Artificial Sequence; identical to SEQ ID NO: 179102
  derived and/or modified sequence opt4 from hemagglutinin__InfluenzaB__AFJ80847

SEQ ID NO: 179316 - RNA, 1758 nt, Artificial Sequence; identical to SEQ ID NO: 179034
  derived and/or modified sequence opt4 from hemagglutinin__InfluenzaB__AFJ80858

SEQ ID NO: 179317 - RNA, 1758 nt, Artificial Sequence; identical to SEQ ID NO: 179034
  derived and/or modified sequence opt4 from hemagglutinin__InfluenzaB__AFJ80869

SEQ ID NO: 179318 - RNA, 1758 nt, Artificial Sequence; identical to SEQ ID NO: 179034
  derived and/or modified sequence opt4 from hemagglutinin__InfluenzaB__AFJ80880

SEQ ID NO: 179319 - RNA, 1758 nt, Artificial Sequence; identical to SEQ ID NO: 179085
  derived and/or modified sequence opt4 from hemagglutinin__InfluenzaB__AFJ80891

SEQ ID NO: 179320 - RNA, 1758 nt, Artificial Sequence; identical to SEQ ID NO: 179085
  derived and/or modified sequence opt4 from hemagglutinin__InfluenzaB__AFJ80902

SEQ ID NO: 179321 - RNA, 1758 nt, Artificial Sequence; identical to SEQ ID NO: 179034
  derived and/or modified sequence opt4 from hemagglutinin__InfluenzaB__AFJ80913

SEQ ID NO: 179322 - RNA, 1758 nt, Artificial Sequence
  derived and/or modified sequence opt4 from hemagglutinin__InfluenzaB__AFJ80924
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcgccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179323 - RNA, 1758 nt, Artificial Sequence; identical to SEQ ID NO: 179085
  derived and/or modified sequence opt4 from hemagglutinin__InfluenzaB__AFJ80935

SEQ ID NO: 179324 - RNA, 1755 nt, Artificial Sequence; identical to SEQ ID NO: 178946
  derived and/or modified sequence opt4 from hemagglutinin__InfluenzaB__AFJ80946

SEQ ID NO: 179325 - RNA, 1758 nt, Artificial Sequence
  derived and/or modified sequence opt4 from hemagglutinin__InfluenzaB__AFJ80957
augaaggccaucaucgugcugcugaugguggccaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179326 - RNA, 1755 nt, Artificial Sequence; identical to SEQ ID NO: 178946
  derived and/or modified sequence opt4 from hemagglutinin__InfluenzaB__AFJ80968

SEQ ID NO: 179327 - RNA, 1755 nt, Artificial Sequence; identical to SEQ ID NO: 178946
  derived and/or modified sequence opt4 from hemagglutinin__InfluenzaB__AFJ80979

SEQ ID NO: 179328 - RNA, 1755 nt, Artificial Sequence
  derived and/or modified sequence opt4 from hemagglutinin__InfluenzaB__AFJ80990
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccgaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccaacaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179329 - RNA, 1755 nt, Artificial Sequence; identical to SEQ ID NO: 178946
  derived and/or modified sequence opt4 from hemagglutinin__InfluenzaB__AFJ81001

SEQ ID NO: 179330 - RNA, 1755 nt, Artificial Sequence; identical to SEQ ID NO: 178946
  derived and/or modified sequence opt4 from hemagglutinin__InfluenzaB__AFJ84360

SEQ ID NO: 179331 - RNA, 1758 nt, Artificial Sequence; identical to SEQ ID NO: 179034
  derived and/or modified sequence opt4 from hemagglutinin__InfluenzaB__AFJ90395

SEQ ID NO: 179332 - RNA, 1755 nt, Artificial Sequence; identical to SEQ ID NO: 178946
  derived and/or modified sequence opt4 from hemagglutinin__InfluenzaB__AFJ90406

SEQ ID NO: 179333 - RNA, 1755 nt, Artificial Sequence; identical to SEQ ID NO: 178946
  derived and/or modified sequence opt4 from hemagglutinin__InfluenzaB__AFJ90417

SEQ ID NO: 179334 - RNA, 1755 nt, Artificial Sequence; identical to SEQ ID NO: 178946
  derived and/or modified sequence opt4 from hemagglutinin__InfluenzaB__AFJ90428

SEQ ID NO: 179335 - RNA, 1755 nt, Artificial Sequence; identical to SEQ ID NO: 178946
  derived and/or modified sequence opt4 from hemagglutinin__InfluenzaB__AFJ90450

SEQ ID NO: 179336 - RNA, 1755 nt, Artificial Sequence; identical to SEQ ID NO: 178946
  derived and/or modified sequence opt4 from hemagglutinin__InfluenzaB__AFJ91038

SEQ ID NO: 179337 - RNA, 1755 nt, Artificial Sequence
  derived and/or modified sequence opt4 from hemagglutinin__InfluenzaB__AFJ91049
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaucacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179338 - RNA, 1758 nt, Artificial Sequence
  derived and/or modified sequence opt4 from hemagglutinin__InfluenzaB__AFJ91060
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccagaugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179339 - RNA, 1755 nt, Artificial Sequence; identical to SEQ ID NO: 178946
  derived and/or modified sequence opt4 from hemagglutinin__InfluenzaB__AFJ91071

SEQ ID NO: 179340 - RNA, 1755 nt, Artificial Sequence
  derived and/or modified sequence opt4 from hemagglutinin__InfluenzaB__AFJ91082
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179341 - RNA, 1755 nt, Artificial Sequence; identical to SEQ ID NO: 179340
  derived and/or modified sequence opt4 from hemagglutinin__InfluenzaB__AFJ91093

SEQ ID NO: 179342 - RNA, 1755 nt, Artificial Sequence; identical to SEQ ID NO: 179340
  derived and/or modified sequence opt4 from hemagglutinin__InfluenzaB__AFJ91104

SEQ ID NO: 179343 - RNA, 1755 nt, Artificial Sequence; identical to SEQ ID NO: 179340
  derived and/or modified sequence opt4 from hemagglutinin__InfluenzaB__AFJ91115

SEQ ID NO: 179344 - RNA, 1758 nt, Artificial Sequence
  derived and/or modified sequence opt4 from hemagglutinin__InfluenzaB__AFJ91704
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaagggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179345 - RNA, 1755 nt, Artificial Sequence
  derived and/or modified sequence opt4 from hemagglutinin__InfluenzaB__AFK09797
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaucaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagaaccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179346 - RNA, 1755 nt, Artificial Sequence; identical to SEQ ID NO: 179340
  derived and/or modified sequence opt4 from hemagglutinin__InfluenzaB__AFN54654

SEQ ID NO: 179347 - RNA, 1755 nt, Artificial Sequence; identical to SEQ ID NO: 179087
  derived and/or modified sequence opt4 from hemagglutinin__InfluenzaB__AFN54665

SEQ ID NO: 179348 - RNA, 1755 nt, Artificial Sequence; identical to SEQ ID NO: 179087
  derived and/or modified sequence opt4 from hemagglutinin__InfluenzaB__AFN54676

SEQ ID NO: 179349 - RNA, 1755 nt, Artificial Sequence; identical to SEQ ID NO: 179340
  derived and/or modified sequence opt4 from hemagglutinin__InfluenzaB__AFN54687

SEQ ID NO: 179350 - RNA, 1755 nt, Artificial Sequence
  derived and/or modified sequence opt4 from hemagglutinin__InfluenzaB__AFN54698
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcuucgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179351 - RNA, 1755 nt, Artificial Sequence; identical to SEQ ID NO: 179340
  derived and/or modified sequence opt4 from hemagglutinin__InfluenzaB__AFN54709

SEQ ID NO: 179352 - RNA, 1755 nt, Artificial Sequence; identical to SEQ ID NO: 179340
  derived and/or modified sequence opt4 from hemagglutinin__InfluenzaB__AFN54720

SEQ ID NO: 179353 - RNA, 1755 nt, Artificial Sequence; identical to SEQ ID NO: 179340
  derived and/or modified sequence opt4 from hemagglutinin__InfluenzaB__AFN54731

SEQ ID NO: 179354 - RNA, 1755 nt, Artificial Sequence; identical to SEQ ID NO: 179340
  derived and/or modified sequence opt4 from hemagglutinin__InfluenzaB__AFN54742

SEQ ID NO: 179355 - RNA, 1755 nt, Artificial Sequence; identical to SEQ ID NO: 179340
  derived and/or modified sequence opt4 from hemagglutinin__InfluenzaB__AFN54753

SEQ ID NO: 179356 - RNA, 1755 nt, Artificial Sequence; identical to SEQ ID NO: 179340
  derived and/or modified sequence opt4 from hemagglutinin__InfluenzaB__AFN54764

SEQ ID NO: 179357 - RNA, 1755 nt, Artificial Sequence; identical to SEQ ID NO: 179340
  derived and/or modified sequence opt4 from hemagglutinin__InfluenzaB__AFN54775

SEQ ID NO: 179358 - RNA, 1755 nt, Artificial Sequence; identical to SEQ ID NO: 179340
  derived and/or modified sequence opt4 from hemagglutinin__InfluenzaB__AFN54786

SEQ ID NO: 179359 - RNA, 1755 nt, Artificial Sequence; identical to SEQ ID NO: 179340
  derived and/or modified sequence opt4 from hemagglutinin__InfluenzaB__AFN54797

SEQ ID NO: 179360 - RNA, 1755 nt, Artificial Sequence; identical to SEQ ID NO: 179340
  derived and/or modified sequence opt4 from hemagglutinin__InfluenzaB__AFN54808

SEQ ID NO: 179361 - RNA, 1755 nt, Artificial Sequence; identical to SEQ ID NO: 179087
  derived and/or modified sequence opt4 from hemagglutinin__InfluenzaB__AFN54819

SEQ ID NO: 179362 - RNA, 1755 nt, Artificial Sequence; identical to SEQ ID NO: 179340
  derived and/or modified sequence opt4 from hemagglutinin__InfluenzaB__AFN54830

SEQ ID NO: 179363 - RNA, 1755 nt, Artificial Sequence; identical to SEQ ID NO: 179340
  derived and/or modified sequence opt4 from hemagglutinin__InfluenzaB__AFN54841

SEQ ID NO: 179364 - RNA, 1755 nt, Artificial Sequence; identical to SEQ ID NO: 179340
  derived and/or modified sequence opt4 from hemagglutinin__InfluenzaB__AFN54852

SEQ ID NO: 179365 - RNA, 1755 nt, Artificial Sequence; identical to SEQ ID NO: 179340
  derived and/or modified sequence opt4 from hemagglutinin__InfluenzaB__AFN54863

SEQ ID NO: 179366 - RNA, 1758 nt, Artificial Sequence
  derived and/or modified sequence opt4 from hemagglutinin__InfluenzaB__AFU34595
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacagagacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccaccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179367 - RNA, 1758 nt, Artificial Sequence
  derived and/or modified sequence opt4 from hemagglutinin__InfluenzaB__AFU34606
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccuggacagacccaagugcaccggcaagauccccagcgccagagugagcauccugcacgaggugagacuggugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacgacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179368 - RNA, 1758 nt, Artificial Sequence; identical to SEQ ID NO: 179276
  derived and/or modified sequence opt4 from hemagglutinin__InfluenzaB__AFU34617

SEQ ID NO: 179369 - RNA, 1758 nt, Artificial Sequence
  derived and/or modified sequence opt4 from hemagglutinin__InfluenzaB__AFU34628
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacgacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuuccugggcgccaucgccggcuuccuggagggcggcuggaagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179370 - RNA, 1758 nt, Artificial Sequence; identical to SEQ ID NO: 179128
  derived and/or modified sequence opt4 from hemagglutinin__InfluenzaB__AFU34639

SEQ ID NO: 179371 - RNA, 1758 nt, Artificial Sequence; identical to SEQ ID NO: 179165
  derived and/or modified sequence opt4 from hemagglutinin__InfluenzaB__AGB08299

SEQ ID NO: 179372 - RNA, 1758 nt, Artificial Sequence; identical to SEQ ID NO: 179165
  derived and/or modified sequence opt4 from hemagglutinin__InfluenzaB__AGB08300

SEQ ID NO: 179373 - RNA, 1755 nt, Artificial Sequence
  derived and/or modified sequence opt4 from hemagglutinin__InfluenzaB__AGB97259
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacaucgugagcagagacaacgugagcugcagcaucugccuguga

SEQ ID NO: 179374 - RNA, 1755 nt, Artificial Sequence
  derived and/or modified sequence opt4 from hemagglutinin__InfluenzaB__AGB97265
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179375 - RNA, 1755 nt, Artificial Sequence; identical to SEQ ID NO: 179374
  derived and/or modified sequence opt4 from hemagglutinin__InfluenzaB__AGF44878

SEQ ID NO: 179376 - RNA, 1755 nt, Artificial Sequence; identical to SEQ ID NO: 179374
  derived and/or modified sequence opt4 from hemagglutinin__InfluenzaB__AGF44879

SEQ ID NO: 179377 - RNA, 1755 nt, Artificial Sequence
  derived and/or modified sequence opt4 from hemagglutinin__InfluenzaB__AGF44881
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugauccugaugcuggccaucuucaucguguacauggugagcagagacaacgugagcugcagcaucugccuguga

SEQ ID NO: 179378 - RNA, 1755 nt, Artificial Sequence
  derived and/or modified sequence opt4 from hemagglutinin__InfluenzaB__AGF44882
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcaagagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179379 - RNA, 1755 nt, Artificial Sequence; identical to SEQ ID NO: 179374
  derived and/or modified sequence opt4 from hemagglutinin__InfluenzaB__AGF44883

SEQ ID NO: 179380 - RNA, 1755 nt, Artificial Sequence; identical to SEQ ID NO: 179374
  derived and/or modified sequence opt4 from hemagglutinin__InfluenzaB__AGF44884

SEQ ID NO: 179381 - RNA, 1755 nt, Artificial Sequence; identical to SEQ ID NO: 179374
  derived and/or modified sequence opt4 from hemagglutinin__InfluenzaB__AGF44886

SEQ ID NO: 179382 - RNA, 1755 nt, Artificial Sequence; identical to SEQ ID NO: 179374
  derived and/or modified sequence opt4 from hemagglutinin__InfluenzaB__AGF44887

SEQ ID NO: 179383 - RNA, 1755 nt, Artificial Sequence; identical to SEQ ID NO: 179374
  derived and/or modified sequence opt4 from hemagglutinin__InfluenzaB__AGF44888

SEQ ID NO: 179384 - RNA, 1755 nt, Artificial Sequence
  derived and/or modified sequence opt4 from hemagglutinin__InfluenzaB__AGL09834
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgacuucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179385 - RNA, 1755 nt, Artificial Sequence; identical to SEQ ID NO: 179374
  derived and/or modified sequence opt4 from hemagglutinin__InfluenzaB__AGL09835

SEQ ID NO: 179386 - RNA, 1755 nt, Artificial Sequence
  derived and/or modified sequence opt4 from hemagglutinin__InfluenzaB__AGL09836
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccaagaaggcccccggcggccccuacagacugggcaccagcggcagcugccccaacgccaccagcaagagcggcuucuucgccaccauggccugggccgugcccgaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179387 - RNA, 1755 nt, Artificial Sequence; identical to SEQ ID NO: 179374
  derived and/or modified sequence opt4 from hemagglutinin__InfluenzaB__AGL09837

SEQ ID NO: 179388 - RNA, 1755 nt, Artificial Sequence; identical to SEQ ID NO: 179374
  derived and/or modified sequence opt4 from hemagglutinin__InfluenzaB__AGL09838

SEQ ID NO: 179389 - RNA, 1755 nt, Artificial Sequence; identical to SEQ ID NO: 179374
  derived and/or modified sequence opt4 from hemagglutinin__InfluenzaB__AGL09839

SEQ ID NO: 179390 - RNA, 1755 nt, Artificial Sequence; identical to SEQ ID NO: 179374
  derived and/or modified sequence opt4 from hemagglutinin__InfluenzaB__AGL09840

SEQ ID NO: 179391 - RNA, 1755 nt, Artificial Sequence; identical to SEQ ID NO: 179374
  derived and/or modified sequence opt4 from hemagglutinin__InfluenzaB__AGL09841

SEQ ID NO: 179392 - RNA, 1758 nt, Artificial Sequence
  derived and/or modified sequence opt4 from hemagglutinin__InfluenzaB__AGL09842
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgagaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179393 - RNA, 1755 nt, Artificial Sequence; identical to SEQ ID NO: 179374
  derived and/or modified sequence opt4 from hemagglutinin__InfluenzaB__AGL09843

SEQ ID NO: 179394 - RNA, 1755 nt, Artificial Sequence
  derived and/or modified sequence opt4 from hemagglutinin__InfluenzaB__AGL09844
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaaggaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179395 - RNA, 1755 nt, Artificial Sequence; identical to SEQ ID NO: 179374
  derived and/or modified sequence opt4 from hemagglutinin__InfluenzaB__AGL09845

SEQ ID NO: 179396 - RNA, 1755 nt, Artificial Sequence; identical to SEQ ID NO: 179374
  derived and/or modified sequence opt4 from hemagglutinin__InfluenzaB__AGL09846

SEQ ID NO: 179397 - RNA, 1755 nt, Artificial Sequence
  derived and/or modified sequence opt4 from hemagglutinin__InfluenzaB__AGL09847
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccaucuggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179398 - RNA, 1755 nt, Artificial Sequence
  derived and/or modified sequence opt4 from hemagglutinin__InfluenzaB__AGL09849
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucaacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179399 - RNA, 1755 nt, Artificial Sequence; identical to SEQ ID NO: 179374
  derived and/or modified sequence opt4 from hemagglutinin__InfluenzaB__AGL09850

SEQ ID NO: 179400 - RNA, 1755 nt, Artificial Sequence; identical to SEQ ID NO: 179374
  derived and/or modified sequence opt4 from hemagglutinin__InfluenzaB__AGL09851

SEQ ID NO: 179401 - RNA, 1758 nt, Artificial Sequence; identical to SEQ ID NO: 179165
  derived and/or modified sequence opt4 from hemagglutinin__InfluenzaB__AGL09852

SEQ ID NO: 179402 - RNA, 1755 nt, Artificial Sequence; identical to SEQ ID NO: 179374
  derived and/or modified sequence opt4 from hemagglutinin__InfluenzaB__AGL09853

SEQ ID NO: 179403 - RNA, 1755 nt, Artificial Sequence; identical to SEQ ID NO: 179374
  derived and/or modified sequence opt4 from hemagglutinin__InfluenzaB__AGL09854

SEQ ID NO: 179404 - RNA, 1758 nt, Artificial Sequence
  derived and/or modified sequence opt4 from hemagglutinin__InfluenzaB__AGL09855
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgagaccaacccccugaccaucgaggugcccuacaucugcaccgaggaggaggaccagaucaccguguggggcuuccacagcgacaacgagacccagauggccaagcuguacggcgacagcaagccccagaaguucaccagcagcgccaacggcgugaccacccacuacgugagccagaucggcgacuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179405 - RNA, 1755 nt, Artificial Sequence; identical to SEQ ID NO: 179374
  derived and/or modified sequence opt4 from hemagglutinin__InfluenzaB__AGL09856

SEQ ID NO: 179406 - RNA, 1755 nt, Artificial Sequence
  derived and/or modified sequence opt4 from hemagglutinin__InfluenzaB__AGL09857
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaaggugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179407 - RNA, 1758 nt, Artificial Sequence
  derived and/or modified sequence opt4 from hemagglutinin__InfluenzaB__AGL09859
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179408 - RNA, 1758 nt, Artificial Sequence; identical to SEQ ID NO: 179407
  derived and/or modified sequence opt4 from hemagglutinin__InfluenzaB__AGL09860

SEQ ID NO: 179409 - RNA, 1758 nt, Artificial Sequence; identical to SEQ ID NO: 179407
  derived and/or modified sequence opt4 from hemagglutinin__InfluenzaB__AGL09861

SEQ ID NO: 179410 - RNA, 1758 nt, Artificial Sequence; identical to SEQ ID NO: 179407
  derived and/or modified sequence opt4 from hemagglutinin__InfluenzaB__AGL09862

SEQ ID NO: 179411 - RNA, 1758 nt, Artificial Sequence; identical to SEQ ID NO: 179407
  derived and/or modified sequence opt4 from hemagglutinin__InfluenzaB__AGL09863

SEQ ID NO: 179412 - RNA, 1755 nt, Artificial Sequence; identical to SEQ ID NO: 179374
  derived and/or modified sequence opt4 from hemagglutinin__InfluenzaB__AGL09864

SEQ ID NO: 179413 - RNA, 1755 nt, Artificial Sequence; identical to SEQ ID NO: 179374
  derived and/or modified sequence opt4 from hemagglutinin__InfluenzaB__AGL09866

SEQ ID NO: 179414 - RNA, 1755 nt, Artificial Sequence; identical to SEQ ID NO: 179374
  derived and/or modified sequence opt4 from hemagglutinin__InfluenzaB__AGL09867

SEQ ID NO: 179415 - RNA, 1755 nt, Artificial Sequence; identical to SEQ ID NO: 179374
  derived and/or modified sequence opt4 from hemagglutinin__InfluenzaB__AGL09868

SEQ ID NO: 179416 - RNA, 1755 nt, Artificial Sequence
  derived and/or modified sequence opt4 from hemagglutinin__InfluenzaB__AGL09869
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacaccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179417 - RNA, 1755 nt, Artificial Sequence
  derived and/or modified sequence opt4 from hemagglutinin__InfluenzaB__AGL09870
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagagauucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179418 - RNA, 1755 nt, Artificial Sequence; identical to SEQ ID NO: 179374
  derived and/or modified sequence opt4 from hemagglutinin__InfluenzaB__AGL09871

SEQ ID NO: 179419 - RNA, 1755 nt, Artificial Sequence
  derived and/or modified sequence opt4 from hemagglutinin__InfluenzaB__AGL09872
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179420 - RNA, 1755 nt, Artificial Sequence; identical to SEQ ID NO: 179374
  derived and/or modified sequence opt4 from hemagglutinin__InfluenzaB__AGL09873

SEQ ID NO: 179421 - RNA, 1758 nt, Artificial Sequence; identical to SEQ ID NO: 179407
  derived and/or modified sequence opt4 from hemagglutinin__InfluenzaB__AGL09874

SEQ ID NO: 179422 - RNA, 1758 nt, Artificial Sequence; identical to SEQ ID NO: 179392
  derived and/or modified sequence opt4 from hemagglutinin__InfluenzaB__AGO02695

SEQ ID NO: 179423 - RNA, 1755 nt, Artificial Sequence; identical to SEQ ID NO: 179374
  derived and/or modified sequence opt4 from hemagglutinin__InfluenzaB__AGQ16249

SEQ ID NO: 179424 - RNA, 1758 nt, Artificial Sequence; identical to SEQ ID NO: 179407
  derived and/or modified sequence opt4 from hemagglutinin__InfluenzaB__AGQ16250

SEQ ID NO: 179425 - RNA, 1758 nt, Artificial Sequence; identical to SEQ ID NO: 179407
  derived and/or modified sequence opt4 from hemagglutinin__InfluenzaB__AGQ16251

SEQ ID NO: 179426 - RNA, 1755 nt, Artificial Sequence
  derived and/or modified sequence opt4 from hemagglutinin__InfluenzaB__AGQ16252
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccgccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179427 - RNA, 1755 nt, Artificial Sequence; identical to SEQ ID NO: 179374
  derived and/or modified sequence opt4 from hemagglutinin__InfluenzaB__AGQ16253

SEQ ID NO: 179428 - RNA, 1755 nt, Artificial Sequence
  derived and/or modified sequence opt4 from hemagglutinin__InfluenzaB__AGQ16255
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaucauccugcuguacuacagcaccgccgccagcagccuggccgugacccugaugcuggccaucuucaucguguacauggugagcagagacaacgugagcugcagcaucugccuguga

SEQ ID NO: 179429 - RNA, 1755 nt, Artificial Sequence
  derived and/or modified sequence opt4 from hemagglutinin__InfluenzaB__AGQ16256
augaaggccaucaucgugcugcugaugguggugaccagcaacgccgacagaaucugcaccggcaucaccagcagcaacagcccccacguggugaagaccgugacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacagcaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179430 - RNA, 1755 nt, Artificial Sequence; identical to SEQ ID NO: 179374
  derived and/or modified sequence opt4 from hemagglutinin__InfluenzaB__AGQ16257

SEQ ID NO: 179431 - RNA, 1755 nt, Artificial Sequence; identical to SEQ ID NO: 179374
  derived and/or modified sequence opt4 from hemagglutinin__InfluenzaB__AGQ16258

SEQ ID NO: 179432 - RNA, 1755 nt, Artificial Sequence; identical to SEQ ID NO: 179374
  derived and/or modified sequence opt4 from hemagglutinin__InfluenzaB__AGQ16259

SEQ ID NO: 179433 - RNA, 1755 nt, Artificial Sequence
  derived and/or modified sequence opt4 from hemagglutinin__InfluenzaB__AGQ16260
augaagaccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcagccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179434 - RNA, 1755 nt, Artificial Sequence; identical to SEQ ID NO: 179374
  derived and/or modified sequence opt4 from hemagglutinin__InfluenzaB__AGQ16261

SEQ ID NO: 179435 - RNA, 1755 nt, Artificial Sequence; identical to SEQ ID NO: 179374
  derived and/or modified sequence opt4 from hemagglutinin__InfluenzaB__AGQ16262

SEQ ID NO: 179436 - RNA, 1758 nt, Artificial Sequence; identical to SEQ ID NO: 179407
  derived and/or modified sequence opt4 from hemagglutinin__InfluenzaB__AGQ16263

SEQ ID NO: 179437 - RNA, 1758 nt, Artificial Sequence; identical to SEQ ID NO: 179407
  derived and/or modified sequence opt4 from hemagglutinin__InfluenzaB__AGQ16264

SEQ ID NO: 179438 - RNA, 1755 nt, Artificial Sequence; identical to SEQ ID NO: 179419
  derived and/or modified sequence opt4 from hemagglutinin__InfluenzaB__AGQ16265

SEQ ID NO: 179439 - RNA, 1755 nt, Artificial Sequence
  derived and/or modified sequence opt4 from hemagglutinin__InfluenzaB__AGQ16266
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccaggugggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179440 - RNA, 1755 nt, Artificial Sequence; identical to SEQ ID NO: 179419
  derived and/or modified sequence opt4 from hemagglutinin__InfluenzaB__AGQ16267

SEQ ID NO: 179441 - RNA, 1755 nt, Artificial Sequence; identical to SEQ ID NO: 179419
  derived and/or modified sequence opt4 from hemagglutinin__InfluenzaB__AGQ16268

SEQ ID NO: 179442 - RNA, 1758 nt, Artificial Sequence; identical to SEQ ID NO: 179392
  derived and/or modified sequence opt4 from hemagglutinin__InfluenzaB__AGQ16269

SEQ ID NO: 179443 - RNA, 1755 nt, Artificial Sequence; identical to SEQ ID NO: 179419
  derived and/or modified sequence opt4 from hemagglutinin__InfluenzaB__AGQ16270

SEQ ID NO: 179444 - RNA, 1755 nt, Artificial Sequence
  derived and/or modified sequence opt4 from hemagglutinin__InfluenzaB__AGQ16272
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccagagacaacaacaagaacgccaccaacccccugaccguggaggugcccuacaucugcgaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179445 - RNA, 1755 nt, Artificial Sequence; identical to SEQ ID NO: 179374
  derived and/or modified sequence opt4 from hemagglutinin__InfluenzaB__AGQ16273

SEQ ID NO: 179446 - RNA, 1755 nt, Artificial Sequence; identical to SEQ ID NO: 179374
  derived and/or modified sequence opt4 from hemagglutinin__InfluenzaB__AGQ16274

SEQ ID NO: 179447 - RNA, 1755 nt, Artificial Sequence; identical to SEQ ID NO: 179374
  derived and/or modified sequence opt4 from hemagglutinin__InfluenzaB__AGQ16275

SEQ ID NO: 179448 - RNA, 1755 nt, Artificial Sequence; identical to SEQ ID NO: 179374
  derived and/or modified sequence opt4 from hemagglutinin__InfluenzaB__AGQ16276

SEQ ID NO: 179449 - RNA, 1755 nt, Artificial Sequence; identical to SEQ ID NO: 179419
  derived and/or modified sequence opt4 from hemagglutinin__InfluenzaB__AGQ16277

SEQ ID NO: 179450 - RNA, 1755 nt, Artificial Sequence; identical to SEQ ID NO: 179419
  derived and/or modified sequence opt4 from hemagglutinin__InfluenzaB__AGQ16278

SEQ ID NO: 179451 - RNA, 1755 nt, Artificial Sequence; identical to SEQ ID NO: 179419
  derived and/or modified sequence opt4 from hemagglutinin__InfluenzaB__AGQ16279

SEQ ID NO: 179452 - RNA, 1755 nt, Artificial Sequence; identical to SEQ ID NO: 179419
  derived and/or modified sequence opt4 from hemagglutinin__InfluenzaB__AGQ16280

SEQ ID NO: 179453 - RNA, 1755 nt, Artificial Sequence
  derived and/or modified sequence opt4 from hemagglutinin__InfluenzaB__AGQ16281
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179454 - RNA, 1755 nt, Artificial Sequence
  derived and/or modified sequence opt4 from hemagglutinin__InfluenzaB__AGQ16282
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaagggcaacaacaagaacgccaccaacccccugaccguggaggugcccuacaucugcgccgagggcgaggaccagaucaccguguggggcuuccacagcgacaacaagacccagaugaagaaccuguacggcgacagcaacccccagagauucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179455 - RNA, 1755 nt, Artificial Sequence
  derived and/or modified sequence opt4 from hemagglutinin__InfluenzaB__AGQ16283
augaaggccaucaucgugcugcugaugguggugaccagcaacgccgacagaaucugcaccggcaucaccagcagcaacagcccccacguggugaagaccgccacccacggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179456 - RNA, 1758 nt, Artificial Sequence
  derived and/or modified sequence opt4 from hemagglutinin__InfluenzaB__AGQ16284
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggccagacccgugaccagcggcugcuuccccaucaugcacgacagaaccaagaucagacagcugcccaaccugcugagaggcuacgagcacaucaagcugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179457 - RNA, 1755 nt, Artificial Sequence; identical to SEQ ID NO: 179419
  derived and/or modified sequence opt4 from hemagglutinin__InfluenzaB__AGQ16285

SEQ ID NO: 179458 - RNA, 1755 nt, Artificial Sequence; identical to SEQ ID NO: 179419
  derived and/or modified sequence opt4 from hemagglutinin__InfluenzaB__AGQ16286

SEQ ID NO: 179459 - RNA, 1755 nt, Artificial Sequence
  derived and/or modified sequence opt4 from hemagglutinin__InfluenzaB__AGQ16287
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179460 - RNA, 1755 nt, Artificial Sequence; identical to SEQ ID NO: 179374
  derived and/or modified sequence opt4 from hemagglutinin__InfluenzaB__AGQ16289

SEQ ID NO: 179461 - RNA, 1755 nt, Artificial Sequence; identical to SEQ ID NO: 179374
  derived and/or modified sequence opt4 from hemagglutinin__InfluenzaB__AGQ16290

SEQ ID NO: 179462 - RNA, 1755 nt, Artificial Sequence
  derived and/or modified sequence opt4 from hemagglutinin__InfluenzaB__AGQ16291
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacaccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179463 - RNA, 1755 nt, Artificial Sequence
  derived and/or modified sequence opt4 from hemagglutinin__InfluenzaB__AGQ16292
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggagaucaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179464 - RNA, 1755 nt, Artificial Sequence; identical to SEQ ID NO: 179463
  derived and/or modified sequence opt4 from hemagglutinin__InfluenzaB__AGQ16293

SEQ ID NO: 179465 - RNA, 1755 nt, Artificial Sequence; identical to SEQ ID NO: 179463
  derived and/or modified sequence opt4 from hemagglutinin__InfluenzaB__AGQ16294

SEQ ID NO: 179466 - RNA, 1758 nt, Artificial Sequence
  derived and/or modified sequence opt4 from hemagglutinin__InfluenzaB__AGQ16295
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgagaccaacccccugaccaucgaggugcccuacaucugcaccgaggaggaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179467 - RNA, 1758 nt, Artificial Sequence; identical to SEQ ID NO: 179407
  derived and/or modified sequence opt4 from hemagglutinin__InfluenzaB__AGQ16296

SEQ ID NO: 179468 - RNA, 1755 nt, Artificial Sequence; identical to SEQ ID NO: 179374
  derived and/or modified sequence opt4 from hemagglutinin__InfluenzaB__AGQ16297

SEQ ID NO: 179469 - RNA, 1755 nt, Artificial Sequence
  derived and/or modified sequence opt4 from hemagglutinin__InfluenzaB__AGQ16298
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccaucgccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179470 - RNA, 1755 nt, Artificial Sequence; identical to SEQ ID NO: 179419
  derived and/or modified sequence opt4 from hemagglutinin__InfluenzaB__AGQ16299

SEQ ID NO: 179471 - RNA, 1755 nt, Artificial Sequence; identical to SEQ ID NO: 179419
  derived and/or modified sequence opt4 from hemagglutinin__InfluenzaB__AGQ16300

SEQ ID NO: 179472 - RNA, 1755 nt, Artificial Sequence; identical to SEQ ID NO: 179374
  derived and/or modified sequence opt4 from hemagglutinin__InfluenzaB__AGQ16301

SEQ ID NO: 179473 - RNA, 1755 nt, Artificial Sequence; identical to SEQ ID NO: 179374
  derived and/or modified sequence opt4 from hemagglutinin__InfluenzaB__AGQ16302

SEQ ID NO: 179474 - RNA, 1755 nt, Artificial Sequence; identical to SEQ ID NO: 179374
  derived and/or modified sequence opt4 from hemagglutinin__InfluenzaB__AGQ16303

SEQ ID NO: 179475 - RNA, 1755 nt, Artificial Sequence; identical to SEQ ID NO: 179374
  derived and/or modified sequence opt4 from hemagglutinin__InfluenzaB__AGQ16305

SEQ ID NO: 179476 - RNA, 1758 nt, Artificial Sequence
  derived and/or modified sequence opt4 from hemagglutinin__InfluenzaB__AGQ16306
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgagaccaacccccugaccaucgaggugcccuacaucugcaaggagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179477 - RNA, 1755 nt, Artificial Sequence; identical to SEQ ID NO: 179374
  derived and/or modified sequence opt4 from hemagglutinin__InfluenzaB__AGQ16307

SEQ ID NO: 179478 - RNA, 1758 nt, Artificial Sequence; identical to SEQ ID NO: 179407
  derived and/or modified sequence opt4 from hemagglutinin__InfluenzaB__AGQ16308

SEQ ID NO: 179479 - RNA, 1755 nt, Artificial Sequence
  derived and/or modified sequence opt4 from hemagglutinin__InfluenzaB__AGQ16309
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucguggccgacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179480 - RNA, 1755 nt, Artificial Sequence
  derived and/or modified sequence opt4 from hemagglutinin__InfluenzaB__AGQ16310
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugguggccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179481 - RNA, 1758 nt, Artificial Sequence; identical to SEQ ID NO: 179407
  derived and/or modified sequence opt4 from hemagglutinin__InfluenzaB__AGQ16311

SEQ ID NO: 179482 - RNA, 1755 nt, Artificial Sequence; identical to SEQ ID NO: 179374
  derived and/or modified sequence opt4 from hemagglutinin__InfluenzaB__AGQ16312

SEQ ID NO: 179483 - RNA, 1755 nt, Artificial Sequence
  derived and/or modified sequence opt4 from hemagglutinin__InfluenzaB__AGQ16313
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagaagggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179484 - RNA, 1758 nt, Artificial Sequence
  derived and/or modified sequence opt4 from hemagglutinin__InfluenzaB__AGQ16314
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgagaccaacccccugaccaucgaggugcccuacaucugcaccgaggaggaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179485 - RNA, 1755 nt, Artificial Sequence
  derived and/or modified sequence opt4 from hemagglutinin__InfluenzaB__AGQ16315
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaccgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaucauccugcuguacuacagcaccgccgccagcagccuggccgugacccugaugcuggccaucuucaucguguacauggugagcagagacaacgugagcugcagcaucugccuguga

SEQ ID NO: 179486 - RNA, 1755 nt, Artificial Sequence; identical to SEQ ID NO: 179374
  derived and/or modified sequence opt4 from hemagglutinin__InfluenzaB__AGQ16316

SEQ ID NO: 179487 - RNA, 1755 nt, Artificial Sequence; identical to SEQ ID NO: 179374
  derived and/or modified sequence opt4 from hemagglutinin__InfluenzaB__AGQ16317

SEQ ID NO: 179488 - RNA, 1758 nt, Artificial Sequence; identical to SEQ ID NO: 179165
  derived and/or modified sequence opt4 from hemagglutinin__InfluenzaB__AGQ16318

SEQ ID NO: 179489 - RNA, 1755 nt, Artificial Sequence
  derived and/or modified sequence opt4 from hemagglutinin__InfluenzaB__AGQ16319
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccggcugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179490 - RNA, 1755 nt, Artificial Sequence; identical to SEQ ID NO: 179419
  derived and/or modified sequence opt4 from hemagglutinin__InfluenzaB__AGQ16320

SEQ ID NO: 179491 - RNA, 1755 nt, Artificial Sequence; identical to SEQ ID NO: 179374
  derived and/or modified sequence opt4 from hemagglutinin__InfluenzaB__AGQ16321

SEQ ID NO: 179492 - RNA, 1755 nt, Artificial Sequence; identical to SEQ ID NO: 179374
  derived and/or modified sequence opt4 from hemagglutinin__InfluenzaB__AGQ16322

SEQ ID NO: 179493 - RNA, 1758 nt, Artificial Sequence
  derived and/or modified sequence opt4 from hemagglutinin__InfluenzaB__AGQ16323
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccagccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179494 - RNA, 1755 nt, Artificial Sequence; identical to SEQ ID NO: 179374
  derived and/or modified sequence opt4 from hemagglutinin__InfluenzaB__AGQ16324

SEQ ID NO: 179495 - RNA, 1755 nt, Artificial Sequence; identical to SEQ ID NO: 179374
  derived and/or modified sequence opt4 from hemagglutinin__InfluenzaB__AGQ16325

SEQ ID NO: 179496 - RNA, 1755 nt, Artificial Sequence; identical to SEQ ID NO: 179374
  derived and/or modified sequence opt4 from hemagglutinin__InfluenzaB__AGQ16326

SEQ ID NO: 179497 - RNA, 1755 nt, Artificial Sequence; identical to SEQ ID NO: 179374
  derived and/or modified sequence opt4 from hemagglutinin__InfluenzaB__AGQ16327

SEQ ID NO: 179498 - RNA, 1758 nt, Artificial Sequence
  derived and/or modified sequence opt4 from hemagglutinin__InfluenzaB__AGQ16328
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagacccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179499 - RNA, 1758 nt, Artificial Sequence
  derived and/or modified sequence opt4 from hemagglutinin__InfluenzaB__AGX15487
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179500 - RNA, 1758 nt, Artificial Sequence; identical to SEQ ID NO: 179499
  derived and/or modified sequence opt4 from hemagglutinin__InfluenzaB__AGX15496

SEQ ID NO: 179501 - RNA, 1758 nt, Artificial Sequence
  derived and/or modified sequence opt4 from hemagglutinin__InfluenzaB__AGX15518
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccgcccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcagcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179502 - RNA, 1758 nt, Artificial Sequence
  derived and/or modified sequence opt4 from hemagglutinin__InfluenzaB__AGX15529
augaaggccaucaucgugcugcugaugguggugaccagcaacgccgacagagugugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccuguacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcacccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179503 - RNA, 1758 nt, Artificial Sequence; identical to SEQ ID NO: 179093
  derived and/or modified sequence opt4 from hemagglutinin__InfluenzaB__AGX15541

SEQ ID NO: 179504 - RNA, 1758 nt, Artificial Sequence
  derived and/or modified sequence opt4 from hemagglutinin__InfluenzaB__AGX15552
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccaagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179505 - RNA, 1758 nt, Artificial Sequence; identical to SEQ ID NO: 179102
  derived and/or modified sequence opt4 from hemagglutinin__InfluenzaB__AGX15563

SEQ ID NO: 179506 - RNA, 1758 nt, Artificial Sequence; identical to SEQ ID NO: 179102
  derived and/or modified sequence opt4 from hemagglutinin__InfluenzaB__AGX15574

SEQ ID NO: 179507 - RNA, 1758 nt, Artificial Sequence
  derived and/or modified sequence opt4 from hemagglutinin__InfluenzaB__AGX15607
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacacccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179508 - RNA, 1758 nt, Artificial Sequence
  derived and/or modified sequence opt4 from hemagglutinin__InfluenzaB__AGX15629
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179509 - RNA, 1758 nt, Artificial Sequence
  derived and/or modified sequence opt4 from hemagglutinin__InfluenzaB__AGX15651
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179510 - RNA, 1758 nt, Artificial Sequence; identical to SEQ ID NO: 179509
  derived and/or modified sequence opt4 from hemagglutinin__InfluenzaB__AGX15675

SEQ ID NO: 179511 - RNA, 1758 nt, Artificial Sequence; identical to SEQ ID NO: 179509
  derived and/or modified sequence opt4 from hemagglutinin__InfluenzaB__AGX15686

SEQ ID NO: 179512 - RNA, 1758 nt, Artificial Sequence
  derived and/or modified sequence opt4 from hemagglutinin__InfluenzaB__AGX15697
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagaaccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179513 - RNA, 1758 nt, Artificial Sequence; identical to SEQ ID NO: 179509
  derived and/or modified sequence opt4 from hemagglutinin__InfluenzaB__AGX15708

SEQ ID NO: 179514 - RNA, 1758 nt, Artificial Sequence; identical to SEQ ID NO: 179509
  derived and/or modified sequence opt4 from hemagglutinin__InfluenzaB__AGX15719

SEQ ID NO: 179515 - RNA, 1758 nt, Artificial Sequence; identical to SEQ ID NO: 179034
  derived and/or modified sequence opt4 from hemagglutinin__InfluenzaB__AGX15730

SEQ ID NO: 179516 - RNA, 1758 nt, Artificial Sequence; identical to SEQ ID NO: 179509
  derived and/or modified sequence opt4 from hemagglutinin__InfluenzaB__AGX15741

SEQ ID NO: 179517 - RNA, 1758 nt, Artificial Sequence; identical to SEQ ID NO: 179509
  derived and/or modified sequence opt4 from hemagglutinin__InfluenzaB__AGX15753

SEQ ID NO: 179518 - RNA, 1758 nt, Artificial Sequence
  derived and/or modified sequence opt4 from hemagglutinin__InfluenzaB__AGX15764
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccaucacccugaugaucgccaucuucgugguguacauggugagcagagacaacgugagcugcagcaucugccuguga

SEQ ID NO: 179519 - RNA, 1755 nt, Artificial Sequence
  derived and/or modified sequence opt4 from hemagglutinin__InfluenzaB__AGX15775
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagauccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179520 - RNA, 1758 nt, Artificial Sequence
  derived and/or modified sequence opt4 from hemagglutinin__InfluenzaB__AGX15786
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucuuccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179521 - RNA, 1758 nt, Artificial Sequence; identical to SEQ ID NO: 179509
  derived and/or modified sequence opt4 from hemagglutinin__InfluenzaB__AGX15797

SEQ ID NO: 179522 - RNA, 1758 nt, Artificial Sequence
  derived and/or modified sequence opt4 from hemagglutinin__InfluenzaB__AGX15808
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccaucggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179523 - RNA, 1758 nt, Artificial Sequence; identical to SEQ ID NO: 179128
  derived and/or modified sequence opt4 from hemagglutinin__InfluenzaB__AGX15830

SEQ ID NO: 179524 - RNA, 1758 nt, Artificial Sequence; identical to SEQ ID NO: 179128
  derived and/or modified sequence opt4 from hemagglutinin__InfluenzaB__AGX15841

SEQ ID NO: 179525 - RNA, 1758 nt, Artificial Sequence; identical to SEQ ID NO: 179128
  derived and/or modified sequence opt4 from hemagglutinin__InfluenzaB__AGX15852

SEQ ID NO: 179526 - RNA, 1758 nt, Artificial Sequence; identical to SEQ ID NO: 179128
  derived and/or modified sequence opt4 from hemagglutinin__InfluenzaB__AGX15863

SEQ ID NO: 179527 - RNA, 1758 nt, Artificial Sequence
  derived and/or modified sequence opt4 from hemagglutinin__InfluenzaB__AGX15874
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccugaacaaccacaccauccugcuguacuacagcaccgccgccagcagccuggccgugacccugaugaucgccaucuucgugguguacauggugagcagagacaacgugagcugcagcaucugccuguga

SEQ ID NO: 179528 - RNA, 1758 nt, Artificial Sequence; identical to SEQ ID NO: 179128
  derived and/or modified sequence opt4 from hemagglutinin__InfluenzaB__AGX15885

SEQ ID NO: 179529 - RNA, 1758 nt, Artificial Sequence
  derived and/or modified sequence opt4 from hemagglutinin__InfluenzaB__AGX15896
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccgcccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacggcgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179530 - RNA, 1758 nt, Artificial Sequence; identical to SEQ ID NO: 179128
  derived and/or modified sequence opt4 from hemagglutinin__InfluenzaB__AGX15907

SEQ ID NO: 179531 - RNA, 1758 nt, Artificial Sequence; identical to SEQ ID NO: 179128
  derived and/or modified sequence opt4 from hemagglutinin__InfluenzaB__AGX15918

SEQ ID NO: 179532 - RNA, 1758 nt, Artificial Sequence
  derived and/or modified sequence opt4 from hemagglutinin__InfluenzaB__AGX15929
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcaccaacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcgagaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179533 - RNA, 1758 nt, Artificial Sequence; identical to SEQ ID NO: 179128
  derived and/or modified sequence opt4 from hemagglutinin__InfluenzaB__AGX15940

SEQ ID NO: 179534 - RNA, 1758 nt, Artificial Sequence
  derived and/or modified sequence opt4 from hemagglutinin__InfluenzaB__AGX15962
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacaugaugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179535 - RNA, 1758 nt, Artificial Sequence; identical to SEQ ID NO: 179165
  derived and/or modified sequence opt4 from hemagglutinin__InfluenzaB__AGX15973

SEQ ID NO: 179536 - RNA, 1758 nt, Artificial Sequence; identical to SEQ ID NO: 179165
  derived and/or modified sequence opt4 from hemagglutinin__InfluenzaB__AGX15984

SEQ ID NO: 179537 - RNA, 1758 nt, Artificial Sequence; identical to SEQ ID NO: 179203
  derived and/or modified sequence opt4 from hemagglutinin__InfluenzaB__AGX15995

SEQ ID NO: 179538 - RNA, 1758 nt, Artificial Sequence; identical to SEQ ID NO: 179203
  derived and/or modified sequence opt4 from hemagglutinin__InfluenzaB__AGX16006

SEQ ID NO: 179539 - RNA, 1758 nt, Artificial Sequence
  derived and/or modified sequence opt4 from hemagglutinin__InfluenzaB__AGX16017
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179540 - RNA, 1755 nt, Artificial Sequence; identical to SEQ ID NO: 178946
  derived and/or modified sequence opt4 from hemagglutinin__InfluenzaB__AGX16028

SEQ ID NO: 179541 - RNA, 1755 nt, Artificial Sequence
  derived and/or modified sequence opt4 from hemagglutinin__InfluenzaB__AGX16039
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccguggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179542 - RNA, 1755 nt, Artificial Sequence
  derived and/or modified sequence opt4 from hemagglutinin__InfluenzaB__AGX16050
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179543 - RNA, 1755 nt, Artificial Sequence
  derived and/or modified sequence opt4 from hemagglutinin__InfluenzaB__AGX16061
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179544 - RNA, 1755 nt, Artificial Sequence
  derived and/or modified sequence opt4 from hemagglutinin__InfluenzaB__AGX16083
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179545 - RNA, 1755 nt, Artificial Sequence
  derived and/or modified sequence opt4 from hemagglutinin__InfluenzaB__AGX16105
augaaggccaucaucgugcugcugaugguggugaccagcaacgccgacagaaucugcaccggcaucaccagcagcagcagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacagcgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179546 - RNA, 1755 nt, Artificial Sequence
  derived and/or modified sequence opt4 from hemagglutinin__InfluenzaB__AGX16116
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggagaucaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179547 - RNA, 1755 nt, Artificial Sequence
  derived and/or modified sequence opt4 from hemagglutinin__InfluenzaB__AGX16127
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggagaucaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179548 - RNA, 1755 nt, Artificial Sequence; identical to SEQ ID NO: 179546
  derived and/or modified sequence opt4 from hemagglutinin__InfluenzaB__AGX16138

SEQ ID NO: 179549 - RNA, 1755 nt, Artificial Sequence; identical to SEQ ID NO: 179543
  derived and/or modified sequence opt4 from hemagglutinin__InfluenzaB__AGX16149

SEQ ID NO: 179550 - RNA, 1755 nt, Artificial Sequence; identical to SEQ ID NO: 179544
  derived and/or modified sequence opt4 from hemagglutinin__InfluenzaB__AGX16160

SEQ ID NO: 179551 - RNA, 1755 nt, Artificial Sequence; identical to SEQ ID NO: 179544
  derived and/or modified sequence opt4 from hemagglutinin__InfluenzaB__AGX16182

SEQ ID NO: 179552 - RNA, 1755 nt, Artificial Sequence; identical to SEQ ID NO: 178946
  derived and/or modified sequence opt4 from hemagglutinin__InfluenzaB__AGX16193

SEQ ID NO: 179553 - RNA, 1755 nt, Artificial Sequence; identical to SEQ ID NO: 178946
  derived and/or modified sequence opt4 from hemagglutinin__InfluenzaB__AGX16215

SEQ ID NO: 179554 - RNA, 1755 nt, Artificial Sequence; identical to SEQ ID NO: 178946
  derived and/or modified sequence opt4 from hemagglutinin__InfluenzaB__AGX16226

SEQ ID NO: 179555 - RNA, 1755 nt, Artificial Sequence
  derived and/or modified sequence opt4 from hemagglutinin__InfluenzaB__AGX16237
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccaucacccugaugcuggccaucuucaucguguacauggugagcagagacaacgugagcugcagcaucugccuguga

SEQ ID NO: 179556 - RNA, 1755 nt, Artificial Sequence; identical to SEQ ID NO: 178946
  derived and/or modified sequence opt4 from hemagglutinin__InfluenzaB__AGX16248

SEQ ID NO: 179557 - RNA, 1755 nt, Artificial Sequence; identical to SEQ ID NO: 178946
  derived and/or modified sequence opt4 from hemagglutinin__InfluenzaB__AGX16259

SEQ ID NO: 179558 - RNA, 1755 nt, Artificial Sequence
  derived and/or modified sequence opt4 from hemagglutinin__InfluenzaB__AGX16270
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179559 - RNA, 1755 nt, Artificial Sequence; identical to SEQ ID NO: 179558
  derived and/or modified sequence opt4 from hemagglutinin__InfluenzaB__AGX16281

SEQ ID NO: 179560 - RNA, 1755 nt, Artificial Sequence
  derived and/or modified sequence opt4 from hemagglutinin__InfluenzaB__AGX16292
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcaaccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcgcccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179561 - RNA, 1758 nt, Artificial Sequence; identical to SEQ ID NO: 179034
  derived and/or modified sequence opt4 from hemagglutinin__InfluenzaB__AGX16303

SEQ ID NO: 179562 - RNA, 1755 nt, Artificial Sequence; identical to SEQ ID NO: 178946
  derived and/or modified sequence opt4 from hemagglutinin__InfluenzaB__AGX16314

SEQ ID NO: 179563 - RNA, 1755 nt, Artificial Sequence; identical to SEQ ID NO: 178946
  derived and/or modified sequence opt4 from hemagglutinin__InfluenzaB__AGX16325

SEQ ID NO: 179564 - RNA, 1755 nt, Artificial Sequence; identical to SEQ ID NO: 179251
  derived and/or modified sequence opt4 from hemagglutinin__InfluenzaB__AGX16336

SEQ ID NO: 179565 - RNA, 1755 nt, Artificial Sequence; identical to SEQ ID NO: 179251
  derived and/or modified sequence opt4 from hemagglutinin__InfluenzaB__AGX16347

SEQ ID NO: 179566 - RNA, 1755 nt, Artificial Sequence; identical to SEQ ID NO: 179251
  derived and/or modified sequence opt4 from hemagglutinin__InfluenzaB__AGX16358

SEQ ID NO: 179567 - RNA, 1755 nt, Artificial Sequence
  derived and/or modified sequence opt4 from hemagglutinin__InfluenzaB__AGX16369
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179568 - RNA, 1755 nt, Artificial Sequence
  derived and/or modified sequence opt4 from hemagglutinin__InfluenzaB__AGX16380
augaaggccaucguggugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcgccacccccagcgccaaggccagcauccugcacgaggugagacccgugaccagcggcugcuuccccaugaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179569 - RNA, 1755 nt, Artificial Sequence; identical to SEQ ID NO: 179087
  derived and/or modified sequence opt4 from hemagglutinin__InfluenzaB__AGX16391

SEQ ID NO: 179570 - RNA, 1755 nt, Artificial Sequence
  derived and/or modified sequence opt4 from hemagglutinin__InfluenzaB__AGX16402
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagccccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179571 - RNA, 1755 nt, Artificial Sequence; identical to SEQ ID NO: 179340
  derived and/or modified sequence opt4 from hemagglutinin__InfluenzaB__AGX16413

SEQ ID NO: 179572 - RNA, 1755 nt, Artificial Sequence; identical to SEQ ID NO: 179340
  derived and/or modified sequence opt4 from hemagglutinin__InfluenzaB__AGX16423

SEQ ID NO: 179573 - RNA, 1755 nt, Artificial Sequence; identical to SEQ ID NO: 179340
  derived and/or modified sequence opt4 from hemagglutinin__InfluenzaB__AGX16434

SEQ ID NO: 179574 - RNA, 1755 nt, Artificial Sequence; identical to SEQ ID NO: 179340
  derived and/or modified sequence opt4 from hemagglutinin__InfluenzaB__AGX16445

SEQ ID NO: 179575 - RNA, 1755 nt, Artificial Sequence; identical to SEQ ID NO: 179340
  derived and/or modified sequence opt4 from hemagglutinin__InfluenzaB__AGX16456

SEQ ID NO: 179576 - RNA, 1755 nt, Artificial Sequence
  derived and/or modified sequence opt4 from hemagglutinin__InfluenzaB__AGX16467
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179577 - RNA, 1755 nt, Artificial Sequence; identical to SEQ ID NO: 179340
  derived and/or modified sequence opt4 from hemagglutinin__InfluenzaB__AGX16478

SEQ ID NO: 179578 - RNA, 1755 nt, Artificial Sequence; identical to SEQ ID NO: 179087
  derived and/or modified sequence opt4 from hemagglutinin__InfluenzaB__AGX16489

SEQ ID NO: 179579 - RNA, 1758 nt, Artificial Sequence; identical to SEQ ID NO: 179499
  derived and/or modified sequence opt4 from hemagglutinin__InfluenzaB__AGX16500

SEQ ID NO: 179580 - RNA, 1758 nt, Artificial Sequence; identical to SEQ ID NO: 179499
  derived and/or modified sequence opt4 from hemagglutinin__InfluenzaB__AGX16511

SEQ ID NO: 179581 - RNA, 1758 nt, Artificial Sequence; identical to SEQ ID NO: 179499
  derived and/or modified sequence opt4 from hemagglutinin__InfluenzaB__AGX16522

SEQ ID NO: 179582 - RNA, 1758 nt, Artificial Sequence
  derived and/or modified sequence opt4 from hemagglutinin__InfluenzaB__AGX16533
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaaggagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179583 - RNA, 1758 nt, Artificial Sequence
  derived and/or modified sequence opt4 from hemagglutinin__InfluenzaB__AGX16555
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179584 - RNA, 1758 nt, Artificial Sequence
  derived and/or modified sequence opt4 from hemagglutinin__InfluenzaB__AGX16566
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179585 - RNA, 1758 nt, Artificial Sequence; identical to SEQ ID NO: 179499
  derived and/or modified sequence opt4 from hemagglutinin__InfluenzaB__AGX16577

SEQ ID NO: 179586 - RNA, 1758 nt, Artificial Sequence
  derived and/or modified sequence opt4 from hemagglutinin__InfluenzaB__AGX16588
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179587 - RNA, 1758 nt, Artificial Sequence; identical to SEQ ID NO: 179499
  derived and/or modified sequence opt4 from hemagglutinin__InfluenzaB__AGX16599

SEQ ID NO: 179588 - RNA, 1758 nt, Artificial Sequence; identical to SEQ ID NO: 179582
  derived and/or modified sequence opt4 from hemagglutinin__InfluenzaB__AGX16610

SEQ ID NO: 179589 - RNA, 1758 nt, Artificial Sequence; identical to SEQ ID NO: 179499
  derived and/or modified sequence opt4 from hemagglutinin__InfluenzaB__AGX16621

SEQ ID NO: 179590 - RNA, 1758 nt, Artificial Sequence
  derived and/or modified sequence opt4 from hemagglutinin__InfluenzaB__AGX16654
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaucaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179591 - RNA, 1758 nt, Artificial Sequence; identical to SEQ ID NO: 179499
  derived and/or modified sequence opt4 from hemagglutinin__InfluenzaB__AGX16665

SEQ ID NO: 179592 - RNA, 1758 nt, Artificial Sequence; identical to SEQ ID NO: 179499
  derived and/or modified sequence opt4 from hemagglutinin__InfluenzaB__AGX16676

SEQ ID NO: 179593 - RNA, 1758 nt, Artificial Sequence; identical to SEQ ID NO: 179499
  derived and/or modified sequence opt4 from hemagglutinin__InfluenzaB__AGX16687

SEQ ID NO: 179594 - RNA, 1758 nt, Artificial Sequence; identical to SEQ ID NO: 179499
  derived and/or modified sequence opt4 from hemagglutinin__InfluenzaB__AGX16698

SEQ ID NO: 179595 - RNA, 1758 nt, Artificial Sequence
  derived and/or modified sequence opt4 from hemagglutinin__InfluenzaB__AGX16709
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccgagaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179596 - RNA, 1758 nt, Artificial Sequence; identical to SEQ ID NO: 179499
  derived and/or modified sequence opt4 from hemagglutinin__InfluenzaB__AGX16720

SEQ ID NO: 179597 - RNA, 1758 nt, Artificial Sequence; identical to SEQ ID NO: 179499
  derived and/or modified sequence opt4 from hemagglutinin__InfluenzaB__AGX16731

SEQ ID NO: 179598 - RNA, 1758 nt, Artificial Sequence
  derived and/or modified sequence opt4 from hemagglutinin__InfluenzaB__AGX16742
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcaucauccacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179599 - RNA, 1758 nt, Artificial Sequence; identical to SEQ ID NO: 179499
  derived and/or modified sequence opt4 from hemagglutinin__InfluenzaB__AGX16753

SEQ ID NO: 179600 - RNA, 1758 nt, Artificial Sequence; identical to SEQ ID NO: 179499
  derived and/or modified sequence opt4 from hemagglutinin__InfluenzaB__AGX16764

SEQ ID NO: 179601 - RNA, 1758 nt, Artificial Sequence; identical to SEQ ID NO: 179499
  derived and/or modified sequence opt4 from hemagglutinin__InfluenzaB__AGX16775

SEQ ID NO: 179602 - RNA, 1758 nt, Artificial Sequence
  derived and/or modified sequence opt4 from hemagglutinin__InfluenzaB__AGX16797
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacaugcccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179603 - RNA, 1758 nt, Artificial Sequence; identical to SEQ ID NO: 179499
  derived and/or modified sequence opt4 from hemagglutinin__InfluenzaB__AGX16808

SEQ ID NO: 179604 - RNA, 1758 nt, Artificial Sequence
  derived and/or modified sequence opt4 from hemagglutinin__InfluenzaB__AGX16819
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179605 - RNA, 1758 nt, Artificial Sequence; identical to SEQ ID NO: 179499
  derived and/or modified sequence opt4 from hemagglutinin__InfluenzaB__AGX16830

SEQ ID NO: 179606 - RNA, 1758 nt, Artificial Sequence
  derived and/or modified sequence opt4 from hemagglutinin__InfluenzaB__AGX16841
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcaugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacggcgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179607 - RNA, 1758 nt, Artificial Sequence
  derived and/or modified sequence opt4 from hemagglutinin__InfluenzaB__AGX16852
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagaaucagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179608 - RNA, 1758 nt, Artificial Sequence; identical to SEQ ID NO: 179499
  derived and/or modified sequence opt4 from hemagglutinin__InfluenzaB__AGX16863

SEQ ID NO: 179609 - RNA, 1758 nt, Artificial Sequence; identical to SEQ ID NO: 179499
  derived and/or modified sequence opt4 from hemagglutinin__InfluenzaB__AGX16874

SEQ ID NO: 179610 - RNA, 1758 nt, Artificial Sequence
  derived and/or modified sequence opt4 from hemagglutinin__InfluenzaB__AGX16885
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179611 - RNA, 1758 nt, Artificial Sequence; identical to SEQ ID NO: 179610
  derived and/or modified sequence opt4 from hemagglutinin__InfluenzaB__AGX16896

SEQ ID NO: 179612 - RNA, 1758 nt, Artificial Sequence; identical to SEQ ID NO: 179499
  derived and/or modified sequence opt4 from hemagglutinin__InfluenzaB__AGX16907

SEQ ID NO: 179613 - RNA, 1758 nt, Artificial Sequence; identical to SEQ ID NO: 179584
  derived and/or modified sequence opt4 from hemagglutinin__InfluenzaB__AGX16918

SEQ ID NO: 179614 - RNA, 1758 nt, Artificial Sequence; identical to SEQ ID NO: 179499
  derived and/or modified sequence opt4 from hemagglutinin__InfluenzaB__AGX16940

SEQ ID NO: 179615 - RNA, 1758 nt, Artificial Sequence; identical to SEQ ID NO: 179610
  derived and/or modified sequence opt4 from hemagglutinin__InfluenzaB__AGX16951

SEQ ID NO: 179616 - RNA, 1758 nt, Artificial Sequence
  derived and/or modified sequence opt4 from hemagglutinin__InfluenzaB__AGX16962
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccgagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaaggaggacggcggccugccccagagcggcagaaucgugguggacuacauggugcagaagagcggcaacaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179617 - RNA, 1758 nt, Artificial Sequence; identical to SEQ ID NO: 179499
  derived and/or modified sequence opt4 from hemagglutinin__InfluenzaB__AGX16973

SEQ ID NO: 179618 - RNA, 1758 nt, Artificial Sequence
  derived and/or modified sequence opt4 from hemagglutinin__InfluenzaB__AGX16995
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccguggaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179619 - RNA, 1758 nt, Artificial Sequence
  derived and/or modified sequence opt4 from hemagglutinin__InfluenzaB__AGX17006
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagaaccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179620 - RNA, 1758 nt, Artificial Sequence; identical to SEQ ID NO: 179499
  derived and/or modified sequence opt4 from hemagglutinin__InfluenzaB__AGX17017

SEQ ID NO: 179621 - RNA, 1758 nt, Artificial Sequence; identical to SEQ ID NO: 179499
  derived and/or modified sequence opt4 from hemagglutinin__InfluenzaB__AGX17028

SEQ ID NO: 179622 - RNA, 1758 nt, Artificial Sequence
  derived and/or modified sequence opt4 from hemagglutinin__InfluenzaB__AGX17039
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccgagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaacaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccaucaugcuguacuacagcaccgccgccagcagccuggccgugacccugaugaucgccaucuucgugguguacauggugagcagagacaacgugagcugcagcaucugccuguga

SEQ ID NO: 179623 - RNA, 1758 nt, Artificial Sequence; identical to SEQ ID NO: 179499
  derived and/or modified sequence opt4 from hemagglutinin__InfluenzaB__AGX17050

SEQ ID NO: 179624 - RNA, 1758 nt, Artificial Sequence
  derived and/or modified sequence opt4 from hemagglutinin__InfluenzaB__AGX17061
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179625 - RNA, 1758 nt, Artificial Sequence
  derived and/or modified sequence opt4 from hemagglutinin__InfluenzaB__AGX17072
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccgagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaacaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179626 - RNA, 1758 nt, Artificial Sequence; identical to SEQ ID NO: 179610
  derived and/or modified sequence opt4 from hemagglutinin__InfluenzaB__AGX17083

SEQ ID NO: 179627 - RNA, 1758 nt, Artificial Sequence
  derived and/or modified sequence opt4 from hemagglutinin__InfluenzaB__AGX17094
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179628 - RNA, 1758 nt, Artificial Sequence
  derived and/or modified sequence opt4 from hemagglutinin__InfluenzaB__AGX17105
augaaggccaucaucgugcugcugaugguggugaccagcaacgccgacagaaucugcaccggcaucaccagcagcaacagcccccacguggugaagaccgccacccagggcgagaucaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugccccacaucugcaccgagggcgaggaccagaucaccguguggggcuuccacagcgacaacgagauccagauggccaagcuguacggcgacagcaagccccagaaguucaccagcagcgccaacggcgugaccacccacuacaucagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179629 - RNA, 1758 nt, Artificial Sequence; identical to SEQ ID NO: 179610
  derived and/or modified sequence opt4 from hemagglutinin__InfluenzaB__AGX17116

SEQ ID NO: 179630 - RNA, 1758 nt, Artificial Sequence
  derived and/or modified sequence opt4 from hemagglutinin__InfluenzaB__AGX17127
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccgagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagaaccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaacaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179631 - RNA, 1758 nt, Artificial Sequence; identical to SEQ ID NO: 179619
  derived and/or modified sequence opt4 from hemagglutinin__InfluenzaB__AGX17138

SEQ ID NO: 179632 - RNA, 1758 nt, Artificial Sequence; identical to SEQ ID NO: 179619
  derived and/or modified sequence opt4 from hemagglutinin__InfluenzaB__AGX17149

SEQ ID NO: 179633 - RNA, 1758 nt, Artificial Sequence
  derived and/or modified sequence opt4 from hemagglutinin__InfluenzaB__AGX17160
augaaggccaucaucgugcugcugaugguggugaccagcaacgccgacagaaucugcaccggcaucaccagcagcaacagcccccacguggugaagaccgccacccagggcgaggugaacgugaccggcaugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179634 - RNA, 1758 nt, Artificial Sequence
  derived and/or modified sequence opt4 from hemagglutinin__InfluenzaB__AGX17171
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccgagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacaacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaacaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179635 - RNA, 1758 nt, Artificial Sequence; identical to SEQ ID NO: 179499
  derived and/or modified sequence opt4 from hemagglutinin__InfluenzaB__AGX17182

SEQ ID NO: 179636 - RNA, 1758 nt, Artificial Sequence; identical to SEQ ID NO: 179499
  derived and/or modified sequence opt4 from hemagglutinin__InfluenzaB__AGX17193

SEQ ID NO: 179637 - RNA, 1758 nt, Artificial Sequence; identical to SEQ ID NO: 179499
  derived and/or modified sequence opt4 from hemagglutinin__InfluenzaB__AGX17204

SEQ ID NO: 179638 - RNA, 1758 nt, Artificial Sequence
  derived and/or modified sequence opt4 from hemagglutinin__InfluenzaB__AGX17215
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179639 - RNA, 1758 nt, Artificial Sequence; identical to SEQ ID NO: 179499
  derived and/or modified sequence opt4 from hemagglutinin__InfluenzaB__AGX17226

SEQ ID NO: 179640 - RNA, 1758 nt, Artificial Sequence
  derived and/or modified sequence opt4 from hemagglutinin__InfluenzaB__AGX17237
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacaucaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179641 - RNA, 1758 nt, Artificial Sequence
  derived and/or modified sequence opt4 from hemagglutinin__InfluenzaB__AGX17248
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179642 - RNA, 1758 nt, Artificial Sequence; identical to SEQ ID NO: 179583
  derived and/or modified sequence opt4 from hemagglutinin__InfluenzaB__AGX17270

SEQ ID NO: 179643 - RNA, 1758 nt, Artificial Sequence; identical to SEQ ID NO: 179499
  derived and/or modified sequence opt4 from hemagglutinin__InfluenzaB__AGX17281

SEQ ID NO: 179644 - RNA, 1758 nt, Artificial Sequence; identical to SEQ ID NO: 179499
  derived and/or modified sequence opt4 from hemagglutinin__InfluenzaB__AGX17292

SEQ ID NO: 179645 - RNA, 1758 nt, Artificial Sequence; identical to SEQ ID NO: 179499
  derived and/or modified sequence opt4 from hemagglutinin__InfluenzaB__AGX17303

SEQ ID NO: 179646 - RNA, 1758 nt, Artificial Sequence; identical to SEQ ID NO: 179625
  derived and/or modified sequence opt4 from hemagglutinin__InfluenzaB__AGX17314

SEQ ID NO: 179647 - RNA, 1758 nt, Artificial Sequence; identical to SEQ ID NO: 179499
  derived and/or modified sequence opt4 from hemagglutinin__InfluenzaB__AGX17325

SEQ ID NO: 179648 - RNA, 1758 nt, Artificial Sequence; identical to SEQ ID NO: 179610
  derived and/or modified sequence opt4 from hemagglutinin__InfluenzaB__AGX17336

SEQ ID NO: 179649 - RNA, 1758 nt, Artificial Sequence; identical to SEQ ID NO: 179499
  derived and/or modified sequence opt4 from hemagglutinin__InfluenzaB__AGX17347

SEQ ID NO: 179650 - RNA, 1758 nt, Artificial Sequence; identical to SEQ ID NO: 179499
  derived and/or modified sequence opt4 from hemagglutinin__InfluenzaB__AGX17358

SEQ ID NO: 179651 - RNA, 1758 nt, Artificial Sequence
  derived and/or modified sequence opt4 from hemagglutinin__InfluenzaB__AGX17369
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucguggccgacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179652 - RNA, 1758 nt, Artificial Sequence; identical to SEQ ID NO: 179625
  derived and/or modified sequence opt4 from hemagglutinin__InfluenzaB__AGX17380

SEQ ID NO: 179653 - RNA, 1758 nt, Artificial Sequence; identical to SEQ ID NO: 179499
  derived and/or modified sequence opt4 from hemagglutinin__InfluenzaB__AGX17391

SEQ ID NO: 179654 - RNA, 1758 nt, Artificial Sequence
  derived and/or modified sequence opt4 from hemagglutinin__InfluenzaB__AGX17400
augaaggccaucaucgugcugcugaugguggugaccagcaacgccgacagaaucugcaccggcaucaccagcagcaacagcccccacauggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179655 - RNA, 1758 nt, Artificial Sequence; identical to SEQ ID NO: 179499
  derived and/or modified sequence opt4 from hemagglutinin__InfluenzaB__AGX17411

SEQ ID NO: 179656 - RNA, 1758 nt, Artificial Sequence; identical to SEQ ID NO: 179499
  derived and/or modified sequence opt4 from hemagglutinin__InfluenzaB__AGX17422

SEQ ID NO: 179657 - RNA, 1758 nt, Artificial Sequence; identical to SEQ ID NO: 179582
  derived and/or modified sequence opt4 from hemagglutinin__InfluenzaB__AGX17433

SEQ ID NO: 179658 - RNA, 1758 nt, Artificial Sequence; identical to SEQ ID NO: 179499
  derived and/or modified sequence opt4 from hemagglutinin__InfluenzaB__AGX17444

SEQ ID NO: 179659 - RNA, 1758 nt, Artificial Sequence; identical to SEQ ID NO: 179582
  derived and/or modified sequence opt4 from hemagglutinin__InfluenzaB__AGX17455

SEQ ID NO: 179660 - RNA, 1758 nt, Artificial Sequence; identical to SEQ ID NO: 179625
  derived and/or modified sequence opt4 from hemagglutinin__InfluenzaB__AGX17466

SEQ ID NO: 179661 - RNA, 1758 nt, Artificial Sequence; identical to SEQ ID NO: 179499
  derived and/or modified sequence opt4 from hemagglutinin__InfluenzaB__AGX17477

SEQ ID NO: 179662 - RNA, 1758 nt, Artificial Sequence; identical to SEQ ID NO: 179584
  derived and/or modified sequence opt4 from hemagglutinin__InfluenzaB__AGX17488

SEQ ID NO: 179663 - RNA, 1758 nt, Artificial Sequence; identical to SEQ ID NO: 179499
  derived and/or modified sequence opt4 from hemagglutinin__InfluenzaB__AGX17499

SEQ ID NO: 179664 - RNA, 1758 nt, Artificial Sequence; identical to SEQ ID NO: 179625
  derived and/or modified sequence opt4 from hemagglutinin__InfluenzaB__AGX17510

SEQ ID NO: 179665 - RNA, 1758 nt, Artificial Sequence; identical to SEQ ID NO: 179625
  derived and/or modified sequence opt4 from hemagglutinin__InfluenzaB__AGX17521

SEQ ID NO: 179666 - RNA, 1758 nt, Artificial Sequence; identical to SEQ ID NO: 179627
  derived and/or modified sequence opt4 from hemagglutinin__InfluenzaB__AGX17532

SEQ ID NO: 179667 - RNA, 1758 nt, Artificial Sequence
  derived and/or modified sequence opt4 from hemagglutinin__InfluenzaB__AGX17543
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccagccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccaugaacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179668 - RNA, 1758 nt, Artificial Sequence
  derived and/or modified sequence opt4 from hemagglutinin__InfluenzaB__AGX17554
augaaggccaucaucgugcugcugcugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179669 - RNA, 1755 nt, Artificial Sequence; identical to SEQ ID NO: 179543
  derived and/or modified sequence opt4 from hemagglutinin__InfluenzaB__AGX17565

SEQ ID NO: 179670 - RNA, 1758 nt, Artificial Sequence
  derived and/or modified sequence opt4 from hemagglutinin__InfluenzaB__AGX17576
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugauggccaucuucgugguguacauggugagcagagacaacgugagcugcagcaucugccuguga

SEQ ID NO: 179671 - RNA, 1758 nt, Artificial Sequence; identical to SEQ ID NO: 179034
  derived and/or modified sequence opt4 from hemagglutinin__InfluenzaB__AGX17598

SEQ ID NO: 179672 - RNA, 1758 nt, Artificial Sequence
  derived and/or modified sequence opt4 from hemagglutinin__InfluenzaB__AGX17609
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179673 - RNA, 1758 nt, Artificial Sequence; identical to SEQ ID NO: 179501
  derived and/or modified sequence opt4 from hemagglutinin__InfluenzaB__AGX17620

SEQ ID NO: 179674 - RNA, 1758 nt, Artificial Sequence; identical to SEQ ID NO: 179034
  derived and/or modified sequence opt4 from hemagglutinin__InfluenzaB__AGX17631

SEQ ID NO: 179675 - RNA, 1758 nt, Artificial Sequence; identical to SEQ ID NO: 179158
  derived and/or modified sequence opt4 from hemagglutinin__InfluenzaB__AGX17642

SEQ ID NO: 179676 - RNA, 1758 nt, Artificial Sequence; identical to SEQ ID NO: 179501
  derived and/or modified sequence opt4 from hemagglutinin__InfluenzaB__AGX17653

SEQ ID NO: 179677 - RNA, 1758 nt, Artificial Sequence; identical to SEQ ID NO: 179034
  derived and/or modified sequence opt4 from hemagglutinin__InfluenzaB__AGX17664

SEQ ID NO: 179678 - RNA, 1758 nt, Artificial Sequence; identical to SEQ ID NO: 179158
  derived and/or modified sequence opt4 from hemagglutinin__InfluenzaB__AGX17675

SEQ ID NO: 179679 - RNA, 1758 nt, Artificial Sequence; identical to SEQ ID NO: 179501
  derived and/or modified sequence opt4 from hemagglutinin__InfluenzaB__AGX17686

SEQ ID NO: 179680 - RNA, 1758 nt, Artificial Sequence
  derived and/or modified sequence opt4 from hemagglutinin__InfluenzaB__AGX17697
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcgagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgccaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179681 - RNA, 1758 nt, Artificial Sequence; identical to SEQ ID NO: 179158
  derived and/or modified sequence opt4 from hemagglutinin__InfluenzaB__AGX17708

SEQ ID NO: 179682 - RNA, 1758 nt, Artificial Sequence; identical to SEQ ID NO: 179501
  derived and/or modified sequence opt4 from hemagglutinin__InfluenzaB__AGX17719

SEQ ID NO: 179683 - RNA, 1758 nt, Artificial Sequence; identical to SEQ ID NO: 179158
  derived and/or modified sequence opt4 from hemagglutinin__InfluenzaB__AGX17730

SEQ ID NO: 179684 - RNA, 1758 nt, Artificial Sequence; identical to SEQ ID NO: 179034
  derived and/or modified sequence opt4 from hemagglutinin__InfluenzaB__AGX17741

SEQ ID NO: 179685 - RNA, 1758 nt, Artificial Sequence; identical to SEQ ID NO: 179501
  derived and/or modified sequence opt4 from hemagglutinin__InfluenzaB__AGX17752

SEQ ID NO: 179686 - RNA, 1758 nt, Artificial Sequence; identical to SEQ ID NO: 179501
  derived and/or modified sequence opt4 from hemagglutinin__InfluenzaB__AGX17774

SEQ ID NO: 179687 - RNA, 1758 nt, Artificial Sequence
  derived and/or modified sequence opt4 from hemagglutinin__InfluenzaB__AGX17785
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacgugagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179688 - RNA, 1758 nt, Artificial Sequence; identical to SEQ ID NO: 179501
  derived and/or modified sequence opt4 from hemagglutinin__InfluenzaB__AGX17796

SEQ ID NO: 179689 - RNA, 1758 nt, Artificial Sequence; identical to SEQ ID NO: 179085
  derived and/or modified sequence opt4 from hemagglutinin__InfluenzaB__AGX17807

SEQ ID NO: 179690 - RNA, 1758 nt, Artificial Sequence; identical to SEQ ID NO: 179672
  derived and/or modified sequence opt4 from hemagglutinin__InfluenzaB__AGX17818

SEQ ID NO: 179691 - RNA, 1758 nt, Artificial Sequence
  derived and/or modified sequence opt4 from hemagglutinin__InfluenzaB__AGX17829
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccgugaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179692 - RNA, 1758 nt, Artificial Sequence; identical to SEQ ID NO: 179158
  derived and/or modified sequence opt4 from hemagglutinin__InfluenzaB__AGX17840

SEQ ID NO: 179693 - RNA, 1758 nt, Artificial Sequence; identical to SEQ ID NO: 179501
  derived and/or modified sequence opt4 from hemagglutinin__InfluenzaB__AGX17851

SEQ ID NO: 179694 - RNA, 1758 nt, Artificial Sequence
  derived and/or modified sequence opt4 from hemagglutinin__InfluenzaB__AGX17862
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcacccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179695 - RNA, 1758 nt, Artificial Sequence
  derived and/or modified sequence opt4 from hemagglutinin__InfluenzaB__AGX17873
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccuggacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179696 - RNA, 1758 nt, Artificial Sequence; identical to SEQ ID NO: 179158
  derived and/or modified sequence opt4 from hemagglutinin__InfluenzaB__AGX17884

SEQ ID NO: 179697 - RNA, 1758 nt, Artificial Sequence
  derived and/or modified sequence opt4 from hemagglutinin__InfluenzaB__AGX17895
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagaaccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179698 - RNA, 1758 nt, Artificial Sequence; identical to SEQ ID NO: 179158
  derived and/or modified sequence opt4 from hemagglutinin__InfluenzaB__AGX17906

SEQ ID NO: 179699 - RNA, 1758 nt, Artificial Sequence; identical to SEQ ID NO: 179158
  derived and/or modified sequence opt4 from hemagglutinin__InfluenzaB__AGX17917

SEQ ID NO: 179700 - RNA, 1758 nt, Artificial Sequence
  derived and/or modified sequence opt4 from hemagglutinin__InfluenzaB__AGX17928
augaagaccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcacccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179701 - RNA, 1758 nt, Artificial Sequence; identical to SEQ ID NO: 179034
  derived and/or modified sequence opt4 from hemagglutinin__InfluenzaB__AGX17939

SEQ ID NO: 179702 - RNA, 1758 nt, Artificial Sequence; identical to SEQ ID NO: 179034
  derived and/or modified sequence opt4 from hemagglutinin__InfluenzaB__AGX17950

SEQ ID NO: 179703 - RNA, 1758 nt, Artificial Sequence; identical to SEQ ID NO: 179034
  derived and/or modified sequence opt4 from hemagglutinin__InfluenzaB__AGX17961

SEQ ID NO: 179704 - RNA, 1758 nt, Artificial Sequence; identical to SEQ ID NO: 179501
  derived and/or modified sequence opt4 from hemagglutinin__InfluenzaB__AGX17972

SEQ ID NO: 179705 - RNA, 1758 nt, Artificial Sequence; identical to SEQ ID NO: 179034
  derived and/or modified sequence opt4 from hemagglutinin__InfluenzaB__AGX17983

SEQ ID NO: 179706 - RNA, 1758 nt, Artificial Sequence; identical to SEQ ID NO: 179158
  derived and/or modified sequence opt4 from hemagglutinin__InfluenzaB__AGX17994

SEQ ID NO: 179707 - RNA, 1758 nt, Artificial Sequence
  derived and/or modified sequence opt4 from hemagglutinin__InfluenzaB__AGX18005
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgacaucaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179708 - RNA, 1758 nt, Artificial Sequence
  derived and/or modified sequence opt4 from hemagglutinin__InfluenzaB__AGX18016
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaucgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179709 - RNA, 1758 nt, Artificial Sequence; identical to SEQ ID NO: 179672
  derived and/or modified sequence opt4 from hemagglutinin__InfluenzaB__AGX18027

SEQ ID NO: 179710 - RNA, 1758 nt, Artificial Sequence; identical to SEQ ID NO: 179158
  derived and/or modified sequence opt4 from hemagglutinin__InfluenzaB__AGX18038

SEQ ID NO: 179711 - RNA, 1758 nt, Artificial Sequence; identical to SEQ ID NO: 179158
  derived and/or modified sequence opt4 from hemagglutinin__InfluenzaB__AGX18049

SEQ ID NO: 179712 - RNA, 1758 nt, Artificial Sequence; identical to SEQ ID NO: 179158
  derived and/or modified sequence opt4 from hemagglutinin__InfluenzaB__AGX18060

SEQ ID NO: 179713 - RNA, 1758 nt, Artificial Sequence; identical to SEQ ID NO: 179034
  derived and/or modified sequence opt4 from hemagglutinin__InfluenzaB__AGX18071

SEQ ID NO: 179714 - RNA, 1758 nt, Artificial Sequence; identical to SEQ ID NO: 179694
  derived and/or modified sequence opt4 from hemagglutinin__InfluenzaB__AGX18082

SEQ ID NO: 179715 - RNA, 1758 nt, Artificial Sequence; identical to SEQ ID NO: 179694
  derived and/or modified sequence opt4 from hemagglutinin__InfluenzaB__AGX18093

SEQ ID NO: 179716 - RNA, 1758 nt, Artificial Sequence; identical to SEQ ID NO: 179501
  derived and/or modified sequence opt4 from hemagglutinin__InfluenzaB__AGX18104

SEQ ID NO: 179717 - RNA, 1758 nt, Artificial Sequence; identical to SEQ ID NO: 179158
  derived and/or modified sequence opt4 from hemagglutinin__InfluenzaB__AGX18115

SEQ ID NO: 179718 - RNA, 1758 nt, Artificial Sequence; identical to SEQ ID NO: 179158
  derived and/or modified sequence opt4 from hemagglutinin__InfluenzaB__AGX18126

SEQ ID NO: 179719 - RNA, 1758 nt, Artificial Sequence; identical to SEQ ID NO: 179034
  derived and/or modified sequence opt4 from hemagglutinin__InfluenzaB__AGX18137

SEQ ID NO: 179720 - RNA, 1758 nt, Artificial Sequence; identical to SEQ ID NO: 179694
  derived and/or modified sequence opt4 from hemagglutinin__InfluenzaB__AGX18148

SEQ ID NO: 179721 - RNA, 1758 nt, Artificial Sequence; identical to SEQ ID NO: 179034
  derived and/or modified sequence opt4 from hemagglutinin__InfluenzaB__AGX18159

SEQ ID NO: 179722 - RNA, 1758 nt, Artificial Sequence; identical to SEQ ID NO: 179034
  derived and/or modified sequence opt4 from hemagglutinin__InfluenzaB__AGX18170

SEQ ID NO: 179723 - RNA, 1758 nt, Artificial Sequence; identical to SEQ ID NO: 179694
  derived and/or modified sequence opt4 from hemagglutinin__InfluenzaB__AGX18181

SEQ ID NO: 179724 - RNA, 1758 nt, Artificial Sequence
  derived and/or modified sequence opt4 from hemagglutinin__InfluenzaB__AGX18192
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcaccaacggcgugaccacccacuacgugagccagaucggcggcuuccccaaccagaccgaggacggcggccugccccagagcggcagaaucgugguggacuacauggugcagaagcccggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcagcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179725 - RNA, 1758 nt, Artificial Sequence; identical to SEQ ID NO: 179672
  derived and/or modified sequence opt4 from hemagglutinin__InfluenzaB__AGX18203

SEQ ID NO: 179726 - RNA, 1758 nt, Artificial Sequence
  derived and/or modified sequence opt4 from hemagglutinin__InfluenzaB__AGX18214
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaccggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaucauccugcuguacuacagcaccgccgccagcagccuggccgugacccugaugaucgccaucuucgugguguacauggugagcagagacaacgugagcugcagcaucugccuguga

SEQ ID NO: 179727 - RNA, 1758 nt, Artificial Sequence
  derived and/or modified sequence opt4 from hemagglutinin__InfluenzaB__AGX18225
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacagaaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179728 - RNA, 1758 nt, Artificial Sequence
  derived and/or modified sequence opt4 from hemagglutinin__InfluenzaB__AGX18236
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacaugaugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179729 - RNA, 1758 nt, Artificial Sequence; identical to SEQ ID NO: 179085
  derived and/or modified sequence opt4 from hemagglutinin__InfluenzaB__AGX18247

SEQ ID NO: 179730 - RNA, 1758 nt, Artificial Sequence
  derived and/or modified sequence opt4 from hemagglutinin__InfluenzaB__AGX18258
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaagaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcacccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179731 - RNA, 1758 nt, Artificial Sequence; identical to SEQ ID NO: 179034
  derived and/or modified sequence opt4 from hemagglutinin__InfluenzaB__AGX18280

SEQ ID NO: 179732 - RNA, 1758 nt, Artificial Sequence
  derived and/or modified sequence opt4 from hemagglutinin__InfluenzaB__AGX18291
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgugagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179733 - RNA, 1758 nt, Artificial Sequence
  derived and/or modified sequence opt4 from hemagglutinin__InfluenzaB__AGX18302
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacaagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcacccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179734 - RNA, 1758 nt, Artificial Sequence; identical to SEQ ID NO: 179034
  derived and/or modified sequence opt4 from hemagglutinin__InfluenzaB__AGX18313

SEQ ID NO: 179735 - RNA, 1758 nt, Artificial Sequence
  derived and/or modified sequence opt4 from hemagglutinin__InfluenzaB__AGX18324
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179736 - RNA, 1758 nt, Artificial Sequence; identical to SEQ ID NO: 179694
  derived and/or modified sequence opt4 from hemagglutinin__InfluenzaB__AGX18335

SEQ ID NO: 179737 - RNA, 1758 nt, Artificial Sequence
  derived and/or modified sequence opt4 from hemagglutinin__InfluenzaB__AGX18346
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgaggacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179738 - RNA, 1758 nt, Artificial Sequence
  derived and/or modified sequence opt4 from hemagglutinin__InfluenzaB__AGX18357
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccgcccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaaggagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcagcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179739 - RNA, 1758 nt, Artificial Sequence
  derived and/or modified sequence opt4 from hemagglutinin__InfluenzaB__AGX18368
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccgcccccaccaagagccacuucgccaaccugaagggcaccaagaccagaggcaagcugugccccaagugccugaacugcaccgaccuggacguggcccugggcagacccaagugcaccggcaacacccccagcgccgaggugagcauccugcacgaggugagacccgugaccagcggcugcuuccccaucaugcacgacagaaccaagaucagacagcugcccaaccugcugagaggcuacgagcacaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcagcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179740 - RNA, 1758 nt, Artificial Sequence; identical to SEQ ID NO: 179158
  derived and/or modified sequence opt4 from hemagglutinin__InfluenzaB__AGX18379

SEQ ID NO: 179741 - RNA, 1758 nt, Artificial Sequence; identical to SEQ ID NO: 179694
  derived and/or modified sequence opt4 from hemagglutinin__InfluenzaB__AGX18390

SEQ ID NO: 179742 - RNA, 1758 nt, Artificial Sequence
  derived and/or modified sequence opt4 from hemagglutinin__InfluenzaB__AGX18401
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccgcccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcagcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179743 - RNA, 1758 nt, Artificial Sequence
  derived and/or modified sequence opt4 from hemagglutinin__InfluenzaB__AGX18412
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179744 - RNA, 1758 nt, Artificial Sequence; identical to SEQ ID NO: 179501
  derived and/or modified sequence opt4 from hemagglutinin__InfluenzaB__AGX18423

SEQ ID NO: 179745 - RNA, 1755 nt, Artificial Sequence
  derived and/or modified sequence opt4 from hemagglutinin__InfluenzaB__AGX18424
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaucaagagccacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccugggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179746 - RNA, 1758 nt, Artificial Sequence
  derived and/or modified sequence opt4 from hemagglutinin__InfluenzaB__AGX18435
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179747 - RNA, 1758 nt, Artificial Sequence; identical to SEQ ID NO: 179158
  derived and/or modified sequence opt4 from hemagglutinin__InfluenzaB__AGX18446

SEQ ID NO: 179748 - RNA, 1758 nt, Artificial Sequence; identical to SEQ ID NO: 179694
  derived and/or modified sequence opt4 from hemagglutinin__InfluenzaB__AGX18457

SEQ ID NO: 179749 - RNA, 1758 nt, Artificial Sequence; identical to SEQ ID NO: 179501
  derived and/or modified sequence opt4 from hemagglutinin__InfluenzaB__AGX18468

SEQ ID NO: 179750 - RNA, 1758 nt, Artificial Sequence; identical to SEQ ID NO: 179694
  derived and/or modified sequence opt4 from hemagglutinin__InfluenzaB__AGX18479

SEQ ID NO: 179751 - RNA, 1758 nt, Artificial Sequence; identical to SEQ ID NO: 179034
  derived and/or modified sequence opt4 from hemagglutinin__InfluenzaB__AGX18490

SEQ ID NO: 179752 - RNA, 1758 nt, Artificial Sequence
  derived and/or modified sequence opt4 from hemagglutinin__InfluenzaB__AGX18512
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcagacugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179753 - RNA, 1758 nt, Artificial Sequence; identical to SEQ ID NO: 179034
  derived and/or modified sequence opt4 from hemagglutinin__InfluenzaB__AGX18523

SEQ ID NO: 179754 - RNA, 1758 nt, Artificial Sequence; identical to SEQ ID NO: 179034
  derived and/or modified sequence opt4 from hemagglutinin__InfluenzaB__AGX18534

SEQ ID NO: 179755 - RNA, 1758 nt, Artificial Sequence; identical to SEQ ID NO: 179095
  derived and/or modified sequence opt4 from hemagglutinin__InfluenzaB__AGX18545

SEQ ID NO: 179756 - RNA, 1758 nt, Artificial Sequence; identical to SEQ ID NO: 179034
  derived and/or modified sequence opt4 from hemagglutinin__InfluenzaB__AGX18556

SEQ ID NO: 179757 - RNA, 1758 nt, Artificial Sequence; identical to SEQ ID NO: 179034
  derived and/or modified sequence opt4 from hemagglutinin__InfluenzaB__AGX18567

SEQ ID NO: 179758 - RNA, 1758 nt, Artificial Sequence
  derived and/or modified sequence opt4 from hemagglutinin__InfluenzaB__AGX18578
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaaggagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179759 - RNA, 1758 nt, Artificial Sequence
  derived and/or modified sequence opt4 from hemagglutinin__InfluenzaB__AGX18589
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaccgagacccagauggccaagcuguacggcgacagcaagccccagaaguucaccagcagcgccaacggcgugaccacccacuacgugagccagaucggcgacuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179760 - RNA, 1758 nt, Artificial Sequence; identical to SEQ ID NO: 179034
  derived and/or modified sequence opt4 from hemagglutinin__InfluenzaB__AGX18600

SEQ ID NO: 179761 - RNA, 1758 nt, Artificial Sequence; identical to SEQ ID NO: 179034
  derived and/or modified sequence opt4 from hemagglutinin__InfluenzaB__AGX18611

SEQ ID NO: 179762 - RNA, 1758 nt, Artificial Sequence; identical to SEQ ID NO: 179034
  derived and/or modified sequence opt4 from hemagglutinin__InfluenzaB__AGX18622

SEQ ID NO: 179763 - RNA, 1758 nt, Artificial Sequence; identical to SEQ ID NO: 179034
  derived and/or modified sequence opt4 from hemagglutinin__InfluenzaB__AGX18633

SEQ ID NO: 179764 - RNA, 1758 nt, Artificial Sequence; identical to SEQ ID NO: 179034
  derived and/or modified sequence opt4 from hemagglutinin__InfluenzaB__AGX18644

SEQ ID NO: 179765 - RNA, 1758 nt, Artificial Sequence; identical to SEQ ID NO: 179034
  derived and/or modified sequence opt4 from hemagglutinin__InfluenzaB__AGX18655

SEQ ID NO: 179766 - RNA, 1758 nt, Artificial Sequence; identical to SEQ ID NO: 179034
  derived and/or modified sequence opt4 from hemagglutinin__InfluenzaB__AGX18666

SEQ ID NO: 179767 - RNA, 1758 nt, Artificial Sequence; identical to SEQ ID NO: 179034
  derived and/or modified sequence opt4 from hemagglutinin__InfluenzaB__AGX18677

SEQ ID NO: 179768 - RNA, 1758 nt, Artificial Sequence; identical to SEQ ID NO: 179034
  derived and/or modified sequence opt4 from hemagglutinin__InfluenzaB__AGX18688

SEQ ID NO: 179769 - RNA, 1758 nt, Artificial Sequence; identical to SEQ ID NO: 179034
  derived and/or modified sequence opt4 from hemagglutinin__InfluenzaB__AGX18699

SEQ ID NO: 179770 - RNA, 1758 nt, Artificial Sequence; identical to SEQ ID NO: 179034
  derived and/or modified sequence opt4 from hemagglutinin__InfluenzaB__AGX18710

SEQ ID NO: 179771 - RNA, 1758 nt, Artificial Sequence; identical to SEQ ID NO: 179034
  derived and/or modified sequence opt4 from hemagglutinin__InfluenzaB__AGX18721

SEQ ID NO: 179772 - RNA, 1758 nt, Artificial Sequence; identical to SEQ ID NO: 179034
  derived and/or modified sequence opt4 from hemagglutinin__InfluenzaB__AGX18732

SEQ ID NO: 179773 - RNA, 1758 nt, Artificial Sequence
  derived and/or modified sequence opt4 from hemagglutinin__InfluenzaB__AGX18743
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcaaccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179774 - RNA, 1758 nt, Artificial Sequence; identical to SEQ ID NO: 179034
  derived and/or modified sequence opt4 from hemagglutinin__InfluenzaB__AGX18754

SEQ ID NO: 179775 - RNA, 1758 nt, Artificial Sequence; identical to SEQ ID NO: 179034
  derived and/or modified sequence opt4 from hemagglutinin__InfluenzaB__AGX18765

SEQ ID NO: 179776 - RNA, 1758 nt, Artificial Sequence; identical to SEQ ID NO: 179085
  derived and/or modified sequence opt4 from hemagglutinin__InfluenzaB__AGX18776

SEQ ID NO: 179777 - RNA, 1758 nt, Artificial Sequence; identical to SEQ ID NO: 179034
  derived and/or modified sequence opt4 from hemagglutinin__InfluenzaB__AGX18787

SEQ ID NO: 179778 - RNA, 1758 nt, Artificial Sequence; identical to SEQ ID NO: 179034
  derived and/or modified sequence opt4 from hemagglutinin__InfluenzaB__AGX18798

SEQ ID NO: 179779 - RNA, 1758 nt, Artificial Sequence
  derived and/or modified sequence opt4 from hemagglutinin__InfluenzaB__AGX18809
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacaugaugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179780 - RNA, 1758 nt, Artificial Sequence; identical to SEQ ID NO: 179697
  derived and/or modified sequence opt4 from hemagglutinin__InfluenzaB__AGX18820

SEQ ID NO: 179781 - RNA, 1758 nt, Artificial Sequence; identical to SEQ ID NO: 179034
  derived and/or modified sequence opt4 from hemagglutinin__InfluenzaB__AGX18831

SEQ ID NO: 179782 - RNA, 1758 nt, Artificial Sequence; identical to SEQ ID NO: 179034
  derived and/or modified sequence opt4 from hemagglutinin__InfluenzaB__AGX18842

SEQ ID NO: 179783 - RNA, 1758 nt, Artificial Sequence; identical to SEQ ID NO: 179102
  derived and/or modified sequence opt4 from hemagglutinin__InfluenzaB__AGX18853

SEQ ID NO: 179784 - RNA, 1758 nt, Artificial Sequence
  derived and/or modified sequence opt4 from hemagglutinin__InfluenzaB__AGX18864
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcaaccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179785 - RNA, 1758 nt, Artificial Sequence
  derived and/or modified sequence opt4 from hemagglutinin__InfluenzaB__AGX18875
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacagaaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccaucgacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179786 - RNA, 1758 nt, Artificial Sequence
  derived and/or modified sequence opt4 from hemagglutinin__InfluenzaB__AGX18886
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacaacggccuggacaaccacaccauccugcuguacuacagcaccgccgccagcagccuggccgugacccugaucaucgccaucuucgugguguacauggugagcagagacaacgugagcugcagcaucugccuguga

SEQ ID NO: 179787 - RNA, 1758 nt, Artificial Sequence; identical to SEQ ID NO: 179507
  derived and/or modified sequence opt4 from hemagglutinin__InfluenzaB__AGX18897

SEQ ID NO: 179788 - RNA, 1758 nt, Artificial Sequence; identical to SEQ ID NO: 179034
  derived and/or modified sequence opt4 from hemagglutinin__InfluenzaB__AGX18908

SEQ ID NO: 179789 - RNA, 1758 nt, Artificial Sequence; identical to SEQ ID NO: 179034
  derived and/or modified sequence opt4 from hemagglutinin__InfluenzaB__AGX18919

SEQ ID NO: 179790 - RNA, 1758 nt, Artificial Sequence
  derived and/or modified sequence opt4 from hemagglutinin__InfluenzaB__AGX18930
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugcaucgacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179791 - RNA, 1758 nt, Artificial Sequence; identical to SEQ ID NO: 179034
  derived and/or modified sequence opt4 from hemagglutinin__InfluenzaB__AGX18941

SEQ ID NO: 179792 - RNA, 1758 nt, Artificial Sequence; identical to SEQ ID NO: 179034
  derived and/or modified sequence opt4 from hemagglutinin__InfluenzaB__AGX18952

SEQ ID NO: 179793 - RNA, 1758 nt, Artificial Sequence; identical to SEQ ID NO: 179034
  derived and/or modified sequence opt4 from hemagglutinin__InfluenzaB__AGX18963

SEQ ID NO: 179794 - RNA, 1758 nt, Artificial Sequence
  derived and/or modified sequence opt4 from hemagglutinin__InfluenzaB__AGX18974
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagaagaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179795 - RNA, 1758 nt, Artificial Sequence; identical to SEQ ID NO: 179034
  derived and/or modified sequence opt4 from hemagglutinin__InfluenzaB__AGX18985

SEQ ID NO: 179796 - RNA, 1758 nt, Artificial Sequence
  derived and/or modified sequence opt4 from hemagglutinin__InfluenzaB__AGX18996
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacacccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacggcacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179797 - RNA, 1758 nt, Artificial Sequence; identical to SEQ ID NO: 179034
  derived and/or modified sequence opt4 from hemagglutinin__InfluenzaB__AGX19007

SEQ ID NO: 179798 - RNA, 1758 nt, Artificial Sequence
  derived and/or modified sequence opt4 from hemagglutinin__InfluenzaB__AGX19018
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaacuuccugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179799 - RNA, 1758 nt, Artificial Sequence; identical to SEQ ID NO: 179697
  derived and/or modified sequence opt4 from hemagglutinin__InfluenzaB__AGX19029

SEQ ID NO: 179800 - RNA, 1758 nt, Artificial Sequence; identical to SEQ ID NO: 179034
  derived and/or modified sequence opt4 from hemagglutinin__InfluenzaB__AGX19040

SEQ ID NO: 179801 - RNA, 1758 nt, Artificial Sequence
  derived and/or modified sequence opt4 from hemagglutinin__InfluenzaB__AGX19051
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacaccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179802 - RNA, 1758 nt, Artificial Sequence
  derived and/or modified sequence opt4 from hemagglutinin__InfluenzaB__AGX19062
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaacuucaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179803 - RNA, 1758 nt, Artificial Sequence; identical to SEQ ID NO: 179034
  derived and/or modified sequence opt4 from hemagglutinin__InfluenzaB__AGX19073

SEQ ID NO: 179804 - RNA, 1758 nt, Artificial Sequence
  derived and/or modified sequence opt4 from hemagglutinin__InfluenzaB__AGX19084
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucaagcugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagaaccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179805 - RNA, 1758 nt, Artificial Sequence; identical to SEQ ID NO: 179034
  derived and/or modified sequence opt4 from hemagglutinin__InfluenzaB__AGX19095

SEQ ID NO: 179806 - RNA, 1758 nt, Artificial Sequence; identical to SEQ ID NO: 179697
  derived and/or modified sequence opt4 from hemagglutinin__InfluenzaB__AGX19106

SEQ ID NO: 179807 - RNA, 1758 nt, Artificial Sequence; identical to SEQ ID NO: 179034
  derived and/or modified sequence opt4 from hemagglutinin__InfluenzaB__AGX19117

SEQ ID NO: 179808 - RNA, 1758 nt, Artificial Sequence
  derived and/or modified sequence opt4 from hemagglutinin__InfluenzaB__AGX19128
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacacccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179809 - RNA, 1758 nt, Artificial Sequence; identical to SEQ ID NO: 179034
  derived and/or modified sequence opt4 from hemagglutinin__InfluenzaB__AGX19139

SEQ ID NO: 179810 - RNA, 1758 nt, Artificial Sequence; identical to SEQ ID NO: 179507
  derived and/or modified sequence opt4 from hemagglutinin__InfluenzaB__AGX19150

SEQ ID NO: 179811 - RNA, 1758 nt, Artificial Sequence; identical to SEQ ID NO: 179034
  derived and/or modified sequence opt4 from hemagglutinin__InfluenzaB__AGX19161

SEQ ID NO: 179812 - RNA, 1758 nt, Artificial Sequence; identical to SEQ ID NO: 179507
  derived and/or modified sequence opt4 from hemagglutinin__InfluenzaB__AGX19172

SEQ ID NO: 179813 - RNA, 1758 nt, Artificial Sequence
  derived and/or modified sequence opt4 from hemagglutinin__InfluenzaB__AGX19183
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaccgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179814 - RNA, 1758 nt, Artificial Sequence; identical to SEQ ID NO: 179034
  derived and/or modified sequence opt4 from hemagglutinin__InfluenzaB__AGX19194

SEQ ID NO: 179815 - RNA, 1758 nt, Artificial Sequence
  derived and/or modified sequence opt4 from hemagglutinin__InfluenzaB__AGX19205
augaaggccaucaucgugcugcugaugguggugaccagcaacgccgacagagugugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179816 - RNA, 1758 nt, Artificial Sequence
  derived and/or modified sequence opt4 from hemagglutinin__InfluenzaB__AGX19216
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagcccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179817 - RNA, 1758 nt, Artificial Sequence
  derived and/or modified sequence opt4 from hemagglutinin__InfluenzaB__AGX19227
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugcccccagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagagcgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179818 - RNA, 1758 nt, Artificial Sequence
  derived and/or modified sequence opt4 from hemagglutinin__InfluenzaB__AGX19238
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179819 - RNA, 1758 nt, Artificial Sequence; identical to SEQ ID NO: 179818
  derived and/or modified sequence opt4 from hemagglutinin__InfluenzaB__AGX19249

SEQ ID NO: 179820 - RNA, 1758 nt, Artificial Sequence; identical to SEQ ID NO: 179034
  derived and/or modified sequence opt4 from hemagglutinin__InfluenzaB__AGX19260

SEQ ID NO: 179821 - RNA, 1758 nt, Artificial Sequence; identical to SEQ ID NO: 179034
  derived and/or modified sequence opt4 from hemagglutinin__InfluenzaB__AGX19271

SEQ ID NO: 179822 - RNA, 1758 nt, Artificial Sequence
  derived and/or modified sequence opt4 from hemagglutinin__InfluenzaB__AGX19282
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179823 - RNA, 1758 nt, Artificial Sequence
  derived and/or modified sequence opt4 from hemagglutinin__InfluenzaB__AGX19304
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaucaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179824 - RNA, 1758 nt, Artificial Sequence; identical to SEQ ID NO: 179823
  derived and/or modified sequence opt4 from hemagglutinin__InfluenzaB__AGX19315

SEQ ID NO: 179825 - RNA, 1758 nt, Artificial Sequence; identical to SEQ ID NO: 179822
  derived and/or modified sequence opt4 from hemagglutinin__InfluenzaB__AGX19326

SEQ ID NO: 179826 - RNA, 1758 nt, Artificial Sequence; identical to SEQ ID NO: 179822
  derived and/or modified sequence opt4 from hemagglutinin__InfluenzaB__AGX19337

SEQ ID NO: 179827 - RNA, 1758 nt, Artificial Sequence
  derived and/or modified sequence opt4 from hemagglutinin__InfluenzaB__AGX19348
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179828 - RNA, 1758 nt, Artificial Sequence; identical to SEQ ID NO: 179822
  derived and/or modified sequence opt4 from hemagglutinin__InfluenzaB__AGX19359

SEQ ID NO: 179829 - RNA, 1755 nt, Artificial Sequence; identical to SEQ ID NO: 179251
  derived and/or modified sequence opt4 from hemagglutinin__InfluenzaB__AGX19370

SEQ ID NO: 179830 - RNA, 1758 nt, Artificial Sequence; identical to SEQ ID NO: 179085
  derived and/or modified sequence opt4 from hemagglutinin__InfluenzaB__AGX19381

SEQ ID NO: 179831 - RNA, 1758 nt, Artificial Sequence; identical to SEQ ID NO: 179822
  derived and/or modified sequence opt4 from hemagglutinin__InfluenzaB__AGX19392

SEQ ID NO: 179832 - RNA, 1758 nt, Artificial Sequence; identical to SEQ ID NO: 179822
  derived and/or modified sequence opt4 from hemagglutinin__InfluenzaB__AGX19403

SEQ ID NO: 179833 - RNA, 1758 nt, Artificial Sequence; identical to SEQ ID NO: 179509
  derived and/or modified sequence opt4 from hemagglutinin__InfluenzaB__AGX19414

SEQ ID NO: 179834 - RNA, 1755 nt, Artificial Sequence
  derived and/or modified sequence opt4 from hemagglutinin__InfluenzaB__AGX19425
augaagaccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugagaaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagagaguguggugcgccagcggcagaagcaaggugaucaagggcgcccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179835 - RNA, 1758 nt, Artificial Sequence; identical to SEQ ID NO: 179034
  derived and/or modified sequence opt4 from hemagglutinin__InfluenzaB__AGX19436

SEQ ID NO: 179836 - RNA, 1758 nt, Artificial Sequence; identical to SEQ ID NO: 179697
  derived and/or modified sequence opt4 from hemagglutinin__InfluenzaB__AGX19447

SEQ ID NO: 179837 - RNA, 1755 nt, Artificial Sequence; identical to SEQ ID NO: 179576
  derived and/or modified sequence opt4 from hemagglutinin__InfluenzaB__AGX19458

SEQ ID NO: 179838 - RNA, 1755 nt, Artificial Sequence; identical to SEQ ID NO: 179576
  derived and/or modified sequence opt4 from hemagglutinin__InfluenzaB__AGX19469

SEQ ID NO: 179839 - RNA, 1758 nt, Artificial Sequence; identical to SEQ ID NO: 179509
  derived and/or modified sequence opt4 from hemagglutinin__InfluenzaB__AGX19480

SEQ ID NO: 179840 - RNA, 1758 nt, Artificial Sequence; identical to SEQ ID NO: 179102
  derived and/or modified sequence opt4 from hemagglutinin__InfluenzaB__AGX19491

SEQ ID NO: 179841 - RNA, 1758 nt, Artificial Sequence
  derived and/or modified sequence opt4 from hemagglutinin__InfluenzaB__AGX19502
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179842 - RNA, 1758 nt, Artificial Sequence
  derived and/or modified sequence opt4 from hemagglutinin__InfluenzaB__AGX19513
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacaucagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179843 - RNA, 1758 nt, Artificial Sequence; identical to SEQ ID NO: 179842
  derived and/or modified sequence opt4 from hemagglutinin__InfluenzaB__AGX19524

SEQ ID NO: 179844 - RNA, 1758 nt, Artificial Sequence
  derived and/or modified sequence opt4 from hemagglutinin__InfluenzaB__AGX19535
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacgacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179845 - RNA, 1758 nt, Artificial Sequence
  derived and/or modified sequence opt4 from hemagglutinin__InfluenzaB__AGX19546
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaaggagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179846 - RNA, 1758 nt, Artificial Sequence
  derived and/or modified sequence opt4 from hemagglutinin__InfluenzaB__AGX19557
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccggcggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179847 - RNA, 1758 nt, Artificial Sequence; identical to SEQ ID NO: 179509
  derived and/or modified sequence opt4 from hemagglutinin__InfluenzaB__AGX19568

SEQ ID NO: 179848 - RNA, 1758 nt, Artificial Sequence; identical to SEQ ID NO: 179842
  derived and/or modified sequence opt4 from hemagglutinin__InfluenzaB__AGX19579

SEQ ID NO: 179849 - RNA, 1758 nt, Artificial Sequence; identical to SEQ ID NO: 179509
  derived and/or modified sequence opt4 from hemagglutinin__InfluenzaB__AGX19590

SEQ ID NO: 179850 - RNA, 1758 nt, Artificial Sequence; identical to SEQ ID NO: 179509
  derived and/or modified sequence opt4 from hemagglutinin__InfluenzaB__AGX19601

SEQ ID NO: 179851 - RNA, 1758 nt, Artificial Sequence; identical to SEQ ID NO: 179509
  derived and/or modified sequence opt4 from hemagglutinin__InfluenzaB__AGX19612

SEQ ID NO: 179852 - RNA, 1758 nt, Artificial Sequence
  derived and/or modified sequence opt4 from hemagglutinin__InfluenzaB__AGX19623
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccguggcccugaugaucgccaucuucgugguguacauggugagcagagacaacgugagcugcagcaucugccuguga

SEQ ID NO: 179853 - RNA, 1758 nt, Artificial Sequence; identical to SEQ ID NO: 179509
  derived and/or modified sequence opt4 from hemagglutinin__InfluenzaB__AGX19634

SEQ ID NO: 179854 - RNA, 1758 nt, Artificial Sequence; identical to SEQ ID NO: 179034
  derived and/or modified sequence opt4 from hemagglutinin__InfluenzaB__AGX19645

SEQ ID NO: 179855 - RNA, 1758 nt, Artificial Sequence; identical to SEQ ID NO: 179085
  derived and/or modified sequence opt4 from hemagglutinin__InfluenzaB__AGX19656

SEQ ID NO: 179856 - RNA, 1758 nt, Artificial Sequence
  derived and/or modified sequence opt4 from hemagglutinin__InfluenzaB__AGX19667
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaaggaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179857 - RNA, 1758 nt, Artificial Sequence; identical to SEQ ID NO: 179509
  derived and/or modified sequence opt4 from hemagglutinin__InfluenzaB__AGX19678

SEQ ID NO: 179858 - RNA, 1758 nt, Artificial Sequence; identical to SEQ ID NO: 179034
  derived and/or modified sequence opt4 from hemagglutinin__InfluenzaB__AGX19700

SEQ ID NO: 179859 - RNA, 1758 nt, Artificial Sequence
  derived and/or modified sequence opt4 from hemagglutinin__InfluenzaB__AGX19711
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacagccugaccaucgaggugcccuacaucugcaaggagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179860 - RNA, 1758 nt, Artificial Sequence; identical to SEQ ID NO: 179509
  derived and/or modified sequence opt4 from hemagglutinin__InfluenzaB__AGX19722

SEQ ID NO: 179861 - RNA, 1758 nt, Artificial Sequence; identical to SEQ ID NO: 179509
  derived and/or modified sequence opt4 from hemagglutinin__InfluenzaB__AGX19733

SEQ ID NO: 179862 - RNA, 1758 nt, Artificial Sequence; identical to SEQ ID NO: 179509
  derived and/or modified sequence opt4 from hemagglutinin__InfluenzaB__AGX19744

SEQ ID NO: 179863 - RNA, 1758 nt, Artificial Sequence; identical to SEQ ID NO: 179034
  derived and/or modified sequence opt4 from hemagglutinin__InfluenzaB__AGX19755

SEQ ID NO: 179864 - RNA, 1758 nt, Artificial Sequence; identical to SEQ ID NO: 179509
  derived and/or modified sequence opt4 from hemagglutinin__InfluenzaB__AGX19766

SEQ ID NO: 179865 - RNA, 1758 nt, Artificial Sequence; identical to SEQ ID NO: 179842
  derived and/or modified sequence opt4 from hemagglutinin__InfluenzaB__AGX19788

SEQ ID NO: 179866 - RNA, 1758 nt, Artificial Sequence; identical to SEQ ID NO: 179509
  derived and/or modified sequence opt4 from hemagglutinin__InfluenzaB__AGX19799

SEQ ID NO: 179867 - RNA, 1758 nt, Artificial Sequence; identical to SEQ ID NO: 179509
  derived and/or modified sequence opt4 from hemagglutinin__InfluenzaB__AGX19810

SEQ ID NO: 179868 - RNA, 1758 nt, Artificial Sequence
  derived and/or modified sequence opt4 from hemagglutinin__InfluenzaB__AGX19821
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcagcauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179869 - RNA, 1758 nt, Artificial Sequence; identical to SEQ ID NO: 179842
  derived and/or modified sequence opt4 from hemagglutinin__InfluenzaB__AGX19832

SEQ ID NO: 179870 - RNA, 1758 nt, Artificial Sequence; identical to SEQ ID NO: 179509
  derived and/or modified sequence opt4 from hemagglutinin__InfluenzaB__AGX19843

SEQ ID NO: 179871 - RNA, 1758 nt, Artificial Sequence; identical to SEQ ID NO: 179509
  derived and/or modified sequence opt4 from hemagglutinin__InfluenzaB__AGX19854

SEQ ID NO: 179872 - RNA, 1758 nt, Artificial Sequence; identical to SEQ ID NO: 179509
  derived and/or modified sequence opt4 from hemagglutinin__InfluenzaB__AGX19865

SEQ ID NO: 179873 - RNA, 1758 nt, Artificial Sequence; identical to SEQ ID NO: 179842
  derived and/or modified sequence opt4 from hemagglutinin__InfluenzaB__AGX19876

SEQ ID NO: 179874 - RNA, 1758 nt, Artificial Sequence; identical to SEQ ID NO: 179509
  derived and/or modified sequence opt4 from hemagglutinin__InfluenzaB__AGX19887

SEQ ID NO: 179875 - RNA, 1758 nt, Artificial Sequence
  derived and/or modified sequence opt4 from hemagglutinin__InfluenzaB__AGX19898
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacgagaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179876 - RNA, 1758 nt, Artificial Sequence; identical to SEQ ID NO: 179034
  derived and/or modified sequence opt4 from hemagglutinin__InfluenzaB__AGX19909

SEQ ID NO: 179877 - RNA, 1758 nt, Artificial Sequence; identical to SEQ ID NO: 179509
  derived and/or modified sequence opt4 from hemagglutinin__InfluenzaB__AGX19920

SEQ ID NO: 179878 - RNA, 1758 nt, Artificial Sequence; identical to SEQ ID NO: 179875
  derived and/or modified sequence opt4 from hemagglutinin__InfluenzaB__AGX19931

SEQ ID NO: 179879 - RNA, 1758 nt, Artificial Sequence; identical to SEQ ID NO: 179842
  derived and/or modified sequence opt4 from hemagglutinin__InfluenzaB__AGX19942

SEQ ID NO: 179880 - RNA, 1758 nt, Artificial Sequence; identical to SEQ ID NO: 179509
  derived and/or modified sequence opt4 from hemagglutinin__InfluenzaB__AGX19953

SEQ ID NO: 179881 - RNA, 1758 nt, Artificial Sequence; identical to SEQ ID NO: 179267
  derived and/or modified sequence opt4 from hemagglutinin__InfluenzaB__AGX19964

SEQ ID NO: 179882 - RNA, 1758 nt, Artificial Sequence; identical to SEQ ID NO: 179034
  derived and/or modified sequence opt4 from hemagglutinin__InfluenzaB__AGX19975

SEQ ID NO: 179883 - RNA, 1758 nt, Artificial Sequence
  derived and/or modified sequence opt4 from hemagglutinin__InfluenzaB__AGX19986
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgugagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179884 - RNA, 1758 nt, Artificial Sequence
  derived and/or modified sequence opt4 from hemagglutinin__InfluenzaB__AGX19997
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaucgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179885 - RNA, 1758 nt, Artificial Sequence; identical to SEQ ID NO: 179509
  derived and/or modified sequence opt4 from hemagglutinin__InfluenzaB__AGX20008

SEQ ID NO: 179886 - RNA, 1758 nt, Artificial Sequence; identical to SEQ ID NO: 179509
  derived and/or modified sequence opt4 from hemagglutinin__InfluenzaB__AGX20019

SEQ ID NO: 179887 - RNA, 1758 nt, Artificial Sequence; identical to SEQ ID NO: 179509
  derived and/or modified sequence opt4 from hemagglutinin__InfluenzaB__AGX20030

SEQ ID NO: 179888 - RNA, 1758 nt, Artificial Sequence
  derived and/or modified sequence opt4 from hemagglutinin__InfluenzaB__AGX20041
augaaggccaucaucgugcugcugaugguggugaccagcgacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaaggagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179889 - RNA, 1758 nt, Artificial Sequence; identical to SEQ ID NO: 179509
  derived and/or modified sequence opt4 from hemagglutinin__InfluenzaB__AGX20052

SEQ ID NO: 179890 - RNA, 1758 nt, Artificial Sequence; identical to SEQ ID NO: 179509
  derived and/or modified sequence opt4 from hemagglutinin__InfluenzaB__AGX20063

SEQ ID NO: 179891 - RNA, 1758 nt, Artificial Sequence
  derived and/or modified sequence opt4 from hemagglutinin__InfluenzaB__AGX20074
augaaggccaucaucgcccugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179892 - RNA, 1758 nt, Artificial Sequence
  derived and/or modified sequence opt4 from hemagglutinin__InfluenzaB__AGX20085
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179893 - RNA, 1758 nt, Artificial Sequence
  derived and/or modified sequence opt4 from hemagglutinin__InfluenzaB__AGX20096
augaaggccaucaucgugcugcugaugguggugaccagcaacgccgacagaaucugcaccggcgugaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179894 - RNA, 1758 nt, Artificial Sequence; identical to SEQ ID NO: 179128
  derived and/or modified sequence opt4 from hemagglutinin__InfluenzaB__AGX20107

SEQ ID NO: 179895 - RNA, 1758 nt, Artificial Sequence; identical to SEQ ID NO: 179128
  derived and/or modified sequence opt4 from hemagglutinin__InfluenzaB__AGX20118

SEQ ID NO: 179896 - RNA, 1758 nt, Artificial Sequence; identical to SEQ ID NO: 179128
  derived and/or modified sequence opt4 from hemagglutinin__InfluenzaB__AGX20129

SEQ ID NO: 179897 - RNA, 1758 nt, Artificial Sequence; identical to SEQ ID NO: 179128
  derived and/or modified sequence opt4 from hemagglutinin__InfluenzaB__AGX20140

SEQ ID NO: 179898 - RNA, 1758 nt, Artificial Sequence; identical to SEQ ID NO: 179128
  derived and/or modified sequence opt4 from hemagglutinin__InfluenzaB__AGX20151

SEQ ID NO: 179899 - RNA, 1758 nt, Artificial Sequence; identical to SEQ ID NO: 179128
  derived and/or modified sequence opt4 from hemagglutinin__InfluenzaB__AGX20162

SEQ ID NO: 179900 - RNA, 1758 nt, Artificial Sequence; identical to SEQ ID NO: 179128
  derived and/or modified sequence opt4 from hemagglutinin__InfluenzaB__AGX20173

SEQ ID NO: 179901 - RNA, 1758 nt, Artificial Sequence; identical to SEQ ID NO: 179128
  derived and/or modified sequence opt4 from hemagglutinin__InfluenzaB__AGX20184

SEQ ID NO: 179902 - RNA, 1758 nt, Artificial Sequence; identical to SEQ ID NO: 179128
  derived and/or modified sequence opt4 from hemagglutinin__InfluenzaB__AGX20195

SEQ ID NO: 179903 - RNA, 1758 nt, Artificial Sequence; identical to SEQ ID NO: 179128
  derived and/or modified sequence opt4 from hemagglutinin__InfluenzaB__AGX20206

SEQ ID NO: 179904 - RNA, 1758 nt, Artificial Sequence; identical to SEQ ID NO: 179128
  derived and/or modified sequence opt4 from hemagglutinin__InfluenzaB__AGX20217

SEQ ID NO: 179905 - RNA, 1758 nt, Artificial Sequence; identical to SEQ ID NO: 179165
  derived and/or modified sequence opt4 from hemagglutinin__InfluenzaB__AGX20228

SEQ ID NO: 179906 - RNA, 1758 nt, Artificial Sequence
  derived and/or modified sequence opt4 from hemagglutinin__InfluenzaB__AGX20239
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaucguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179907 - RNA, 1758 nt, Artificial Sequence; identical to SEQ ID NO: 179128
  derived and/or modified sequence opt4 from hemagglutinin__InfluenzaB__AGX20250

SEQ ID NO: 179908 - RNA, 1758 nt, Artificial Sequence; identical to SEQ ID NO: 179128
  derived and/or modified sequence opt4 from hemagglutinin__InfluenzaB__AGX20261

SEQ ID NO: 179909 - RNA, 1758 nt, Artificial Sequence; identical to SEQ ID NO: 179128
  derived and/or modified sequence opt4 from hemagglutinin__InfluenzaB__AGX20272

SEQ ID NO: 179910 - RNA, 1758 nt, Artificial Sequence; identical to SEQ ID NO: 179128
  derived and/or modified sequence opt4 from hemagglutinin__InfluenzaB__AGX20283

SEQ ID NO: 179911 - RNA, 1758 nt, Artificial Sequence; identical to SEQ ID NO: 179128
  derived and/or modified sequence opt4 from hemagglutinin__InfluenzaB__AGX20294

SEQ ID NO: 179912 - RNA, 1758 nt, Artificial Sequence
  derived and/or modified sequence opt4 from hemagglutinin__InfluenzaB__AGX20305
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaaccagcugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179913 - RNA, 1758 nt, Artificial Sequence; identical to SEQ ID NO: 179128
  derived and/or modified sequence opt4 from hemagglutinin__InfluenzaB__AGX20316

SEQ ID NO: 179914 - RNA, 1758 nt, Artificial Sequence; identical to SEQ ID NO: 179128
  derived and/or modified sequence opt4 from hemagglutinin__InfluenzaB__AGX20327

SEQ ID NO: 179915 - RNA, 1758 nt, Artificial Sequence
  derived and/or modified sequence opt4 from hemagglutinin__InfluenzaB__AGX20338
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaaccuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179916 - RNA, 1758 nt, Artificial Sequence; identical to SEQ ID NO: 179128
  derived and/or modified sequence opt4 from hemagglutinin__InfluenzaB__AGX20349

SEQ ID NO: 179917 - RNA, 1758 nt, Artificial Sequence; identical to SEQ ID NO: 179128
  derived and/or modified sequence opt4 from hemagglutinin__InfluenzaB__AGX20360

SEQ ID NO: 179918 - RNA, 1758 nt, Artificial Sequence; identical to SEQ ID NO: 179165
  derived and/or modified sequence opt4 from hemagglutinin__InfluenzaB__AGX20371

SEQ ID NO: 179919 - RNA, 1758 nt, Artificial Sequence
  derived and/or modified sequence opt4 from hemagglutinin__InfluenzaB__AGX20382
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccaugaacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179920 - RNA, 1758 nt, Artificial Sequence; identical to SEQ ID NO: 179128
  derived and/or modified sequence opt4 from hemagglutinin__InfluenzaB__AGX20393

SEQ ID NO: 179921 - RNA, 1758 nt, Artificial Sequence; identical to SEQ ID NO: 179165
  derived and/or modified sequence opt4 from hemagglutinin__InfluenzaB__AGX20404

SEQ ID NO: 179922 - RNA, 1758 nt, Artificial Sequence; identical to SEQ ID NO: 179128
  derived and/or modified sequence opt4 from hemagglutinin__InfluenzaB__AGX20415

SEQ ID NO: 179923 - RNA, 1758 nt, Artificial Sequence; identical to SEQ ID NO: 179128
  derived and/or modified sequence opt4 from hemagglutinin__InfluenzaB__AGX20426

SEQ ID NO: 179924 - RNA, 1758 nt, Artificial Sequence; identical to SEQ ID NO: 179128
  derived and/or modified sequence opt4 from hemagglutinin__InfluenzaB__AGX20437

SEQ ID NO: 179925 - RNA, 1758 nt, Artificial Sequence; identical to SEQ ID NO: 179128
  derived and/or modified sequence opt4 from hemagglutinin__InfluenzaB__AGX20448

SEQ ID NO: 179926 - RNA, 1758 nt, Artificial Sequence; identical to SEQ ID NO: 179128
  derived and/or modified sequence opt4 from hemagglutinin__InfluenzaB__AGX20459

SEQ ID NO: 179927 - RNA, 1758 nt, Artificial Sequence; identical to SEQ ID NO: 179128
  derived and/or modified sequence opt4 from hemagglutinin__InfluenzaB__AGX20470

SEQ ID NO: 179928 - RNA, 1758 nt, Artificial Sequence; identical to SEQ ID NO: 179128
  derived and/or modified sequence opt4 from hemagglutinin__InfluenzaB__AGX20481

SEQ ID NO: 179929 - RNA, 1758 nt, Artificial Sequence; identical to SEQ ID NO: 179128
  derived and/or modified sequence opt4 from hemagglutinin__InfluenzaB__AGX20492

SEQ ID NO: 179930 - RNA, 1758 nt, Artificial Sequence; identical to SEQ ID NO: 179128
  derived and/or modified sequence opt4 from hemagglutinin__InfluenzaB__AGX20503

SEQ ID NO: 179931 - RNA, 1758 nt, Artificial Sequence; identical to SEQ ID NO: 179128
  derived and/or modified sequence opt4 from hemagglutinin__InfluenzaB__AGX20514

SEQ ID NO: 179932 - RNA, 1758 nt, Artificial Sequence
  derived and/or modified sequence opt4 from hemagglutinin__InfluenzaB__AGX20525
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucagcaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179933 - RNA, 1758 nt, Artificial Sequence; identical to SEQ ID NO: 179128
  derived and/or modified sequence opt4 from hemagglutinin__InfluenzaB__AGX20536

SEQ ID NO: 179934 - RNA, 1758 nt, Artificial Sequence
  derived and/or modified sequence opt4 from hemagglutinin__InfluenzaB__AGX20547
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccaccacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggagaucaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179935 - RNA, 1758 nt, Artificial Sequence; identical to SEQ ID NO: 179182
  derived and/or modified sequence opt4 from hemagglutinin__InfluenzaB__AGX20558

SEQ ID NO: 179936 - RNA, 1758 nt, Artificial Sequence; identical to SEQ ID NO: 179128
  derived and/or modified sequence opt4 from hemagglutinin__InfluenzaB__AGX20569

SEQ ID NO: 179937 - RNA, 1758 nt, Artificial Sequence; identical to SEQ ID NO: 179165
  derived and/or modified sequence opt4 from hemagglutinin__InfluenzaB__AGX20580

SEQ ID NO: 179938 - RNA, 1758 nt, Artificial Sequence; identical to SEQ ID NO: 179128
  derived and/or modified sequence opt4 from hemagglutinin__InfluenzaB__AGX20591

SEQ ID NO: 179939 - RNA, 1758 nt, Artificial Sequence; identical to SEQ ID NO: 179128
  derived and/or modified sequence opt4 from hemagglutinin__InfluenzaB__AGX20602

SEQ ID NO: 179940 - RNA, 1758 nt, Artificial Sequence; identical to SEQ ID NO: 179128
  derived and/or modified sequence opt4 from hemagglutinin__InfluenzaB__AGX20613

SEQ ID NO: 179941 - RNA, 1758 nt, Artificial Sequence; identical to SEQ ID NO: 179128
  derived and/or modified sequence opt4 from hemagglutinin__InfluenzaB__AGX20624

SEQ ID NO: 179942 - RNA, 1758 nt, Artificial Sequence
  derived and/or modified sequence opt4 from hemagglutinin__InfluenzaB__AGX20635
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccugauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179943 - RNA, 1758 nt, Artificial Sequence; identical to SEQ ID NO: 179128
  derived and/or modified sequence opt4 from hemagglutinin__InfluenzaB__AGX20646

SEQ ID NO: 179944 - RNA, 1758 nt, Artificial Sequence
  derived and/or modified sequence opt4 from hemagglutinin__InfluenzaB__AGX20668
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaccaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179945 - RNA, 1758 nt, Artificial Sequence; identical to SEQ ID NO: 179203
  derived and/or modified sequence opt4 from hemagglutinin__InfluenzaB__AGX20679

SEQ ID NO: 179946 - RNA, 1758 nt, Artificial Sequence; identical to SEQ ID NO: 179165
  derived and/or modified sequence opt4 from hemagglutinin__InfluenzaB__AGX20690

SEQ ID NO: 179947 - RNA, 1758 nt, Artificial Sequence; identical to SEQ ID NO: 179165
  derived and/or modified sequence opt4 from hemagglutinin__InfluenzaB__AGX20701

SEQ ID NO: 179948 - RNA, 1758 nt, Artificial Sequence; identical to SEQ ID NO: 179509
  derived and/or modified sequence opt4 from hemagglutinin__InfluenzaB__AGX20712

SEQ ID NO: 179949 - RNA, 1758 nt, Artificial Sequence; identical to SEQ ID NO: 179128
  derived and/or modified sequence opt4 from hemagglutinin__InfluenzaB__AGX20723

SEQ ID NO: 179950 - RNA, 1758 nt, Artificial Sequence
  derived and/or modified sequence opt4 from hemagglutinin__InfluenzaB__AGX20734
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcaccaacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179951 - RNA, 1758 nt, Artificial Sequence
  derived and/or modified sequence opt4 from hemagglutinin__InfluenzaB__AGX20745
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179952 - RNA, 1758 nt, Artificial Sequence; identical to SEQ ID NO: 179509
  derived and/or modified sequence opt4 from hemagglutinin__InfluenzaB__AGX20756

SEQ ID NO: 179953 - RNA, 1758 nt, Artificial Sequence; identical to SEQ ID NO: 179128
  derived and/or modified sequence opt4 from hemagglutinin__InfluenzaB__AGX20767

SEQ ID NO: 179954 - RNA, 1758 nt, Artificial Sequence; identical to SEQ ID NO: 179165
  derived and/or modified sequence opt4 from hemagglutinin__InfluenzaB__AGX20778

SEQ ID NO: 179955 - RNA, 1758 nt, Artificial Sequence
  derived and/or modified sequence opt4 from hemagglutinin__InfluenzaB__AGX20789
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacggcgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179956 - RNA, 1758 nt, Artificial Sequence
  derived and/or modified sequence opt4 from hemagglutinin__InfluenzaB__AGX20800
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacgagcuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179957 - RNA, 1758 nt, Artificial Sequence; identical to SEQ ID NO: 179203
  derived and/or modified sequence opt4 from hemagglutinin__InfluenzaB__AGX20811

SEQ ID NO: 179958 - RNA, 1758 nt, Artificial Sequence; identical to SEQ ID NO: 179203
  derived and/or modified sequence opt4 from hemagglutinin__InfluenzaB__AGX20822

SEQ ID NO: 179959 - RNA, 1758 nt, Artificial Sequence; identical to SEQ ID NO: 179203
  derived and/or modified sequence opt4 from hemagglutinin__InfluenzaB__AGX20833

SEQ ID NO: 179960 - RNA, 1758 nt, Artificial Sequence
  derived and/or modified sequence opt4 from hemagglutinin__InfluenzaB__AGX20844
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaugggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179961 - RNA, 1758 nt, Artificial Sequence; identical to SEQ ID NO: 179128
  derived and/or modified sequence opt4 from hemagglutinin__InfluenzaB__AGX20855

SEQ ID NO: 179962 - RNA, 1758 nt, Artificial Sequence; identical to SEQ ID NO: 179203
  derived and/or modified sequence opt4 from hemagglutinin__InfluenzaB__AGX20866

SEQ ID NO: 179963 - RNA, 1758 nt, Artificial Sequence; identical to SEQ ID NO: 179203
  derived and/or modified sequence opt4 from hemagglutinin__InfluenzaB__AGX20877

SEQ ID NO: 179964 - RNA, 1758 nt, Artificial Sequence
  derived and/or modified sequence opt4 from hemagglutinin__InfluenzaB__AGX20888
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179965 - RNA, 1758 nt, Artificial Sequence; identical to SEQ ID NO: 179203
  derived and/or modified sequence opt4 from hemagglutinin__InfluenzaB__AGX20899

SEQ ID NO: 179966 - RNA, 1758 nt, Artificial Sequence; identical to SEQ ID NO: 179203
  derived and/or modified sequence opt4 from hemagglutinin__InfluenzaB__AGX20910

SEQ ID NO: 179967 - RNA, 1758 nt, Artificial Sequence; identical to SEQ ID NO: 179128
  derived and/or modified sequence opt4 from hemagglutinin__InfluenzaB__AGX20921

SEQ ID NO: 179968 - RNA, 1758 nt, Artificial Sequence
  derived and/or modified sequence opt4 from hemagglutinin__InfluenzaB__AGX20932
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgaccccaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179969 - RNA, 1758 nt, Artificial Sequence; identical to SEQ ID NO: 179128
  derived and/or modified sequence opt4 from hemagglutinin__InfluenzaB__AGX20943

SEQ ID NO: 179970 - RNA, 1758 nt, Artificial Sequence; identical to SEQ ID NO: 179128
  derived and/or modified sequence opt4 from hemagglutinin__InfluenzaB__AGX20954

SEQ ID NO: 179971 - RNA, 1758 nt, Artificial Sequence; identical to SEQ ID NO: 179128
  derived and/or modified sequence opt4 from hemagglutinin__InfluenzaB__AGX20965

SEQ ID NO: 179972 - RNA, 1758 nt, Artificial Sequence
  derived and/or modified sequence opt4 from hemagglutinin__InfluenzaB__AGX20976
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacggcgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179973 - RNA, 1758 nt, Artificial Sequence; identical to SEQ ID NO: 179128
  derived and/or modified sequence opt4 from hemagglutinin__InfluenzaB__AGX20987

SEQ ID NO: 179974 - RNA, 1758 nt, Artificial Sequence; identical to SEQ ID NO: 179203
  derived and/or modified sequence opt4 from hemagglutinin__InfluenzaB__AGX20998

SEQ ID NO: 179975 - RNA, 1758 nt, Artificial Sequence
  derived and/or modified sequence opt4 from hemagglutinin__InfluenzaB__AGX21009
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacaugaucagcagagacaacgugagcugcagcaucugccuguga

SEQ ID NO: 179976 - RNA, 1758 nt, Artificial Sequence
  derived and/or modified sequence opt4 from hemagglutinin__InfluenzaB__AGX21020
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcgagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179977 - RNA, 1758 nt, Artificial Sequence; identical to SEQ ID NO: 179203
  derived and/or modified sequence opt4 from hemagglutinin__InfluenzaB__AGX21031

SEQ ID NO: 179978 - RNA, 1758 nt, Artificial Sequence
  derived and/or modified sequence opt4 from hemagglutinin__InfluenzaB__AGX21042
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacaccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179979 - RNA, 1758 nt, Artificial Sequence; identical to SEQ ID NO: 179165
  derived and/or modified sequence opt4 from hemagglutinin__InfluenzaB__AGX21053

SEQ ID NO: 179980 - RNA, 1758 nt, Artificial Sequence; identical to SEQ ID NO: 179128
  derived and/or modified sequence opt4 from hemagglutinin__InfluenzaB__AGX21064

SEQ ID NO: 179981 - RNA, 1758 nt, Artificial Sequence; identical to SEQ ID NO: 179165
  derived and/or modified sequence opt4 from hemagglutinin__InfluenzaB__AGX21075

SEQ ID NO: 179982 - RNA, 1758 nt, Artificial Sequence; identical to SEQ ID NO: 179165
  derived and/or modified sequence opt4 from hemagglutinin__InfluenzaB__AGX21084

SEQ ID NO: 179983 - RNA, 1758 nt, Artificial Sequence; identical to SEQ ID NO: 179165
  derived and/or modified sequence opt4 from hemagglutinin__InfluenzaB__AGX21095

SEQ ID NO: 179984 - RNA, 1758 nt, Artificial Sequence
  derived and/or modified sequence opt4 from hemagglutinin__InfluenzaB__AGX21106
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179985 - RNA, 1758 nt, Artificial Sequence; identical to SEQ ID NO: 179128
  derived and/or modified sequence opt4 from hemagglutinin__InfluenzaB__AGX21117

SEQ ID NO: 179986 - RNA, 1758 nt, Artificial Sequence; identical to SEQ ID NO: 179978
  derived and/or modified sequence opt4 from hemagglutinin__InfluenzaB__AGX21128

SEQ ID NO: 179987 - RNA, 1758 nt, Artificial Sequence
  derived and/or modified sequence opt4 from hemagglutinin__InfluenzaB__AGX21139
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcgacuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179988 - RNA, 1758 nt, Artificial Sequence; identical to SEQ ID NO: 179203
  derived and/or modified sequence opt4 from hemagglutinin__InfluenzaB__AGX21150

SEQ ID NO: 179989 - RNA, 1758 nt, Artificial Sequence; identical to SEQ ID NO: 179128
  derived and/or modified sequence opt4 from hemagglutinin__InfluenzaB__AGX21161

SEQ ID NO: 179990 - RNA, 1758 nt, Artificial Sequence; identical to SEQ ID NO: 179203
  derived and/or modified sequence opt4 from hemagglutinin__InfluenzaB__AGX21172

SEQ ID NO: 179991 - RNA, 1758 nt, Artificial Sequence; identical to SEQ ID NO: 179165
  derived and/or modified sequence opt4 from hemagglutinin__InfluenzaB__AGX21183

SEQ ID NO: 179992 - RNA, 1758 nt, Artificial Sequence; identical to SEQ ID NO: 179203
  derived and/or modified sequence opt4 from hemagglutinin__InfluenzaB__AGX21194

SEQ ID NO: 179993 - RNA, 1758 nt, Artificial Sequence
  derived and/or modified sequence opt4 from hemagglutinin__InfluenzaB__AGX21205
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccaagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179994 - RNA, 1758 nt, Artificial Sequence; identical to SEQ ID NO: 179165
  derived and/or modified sequence opt4 from hemagglutinin__InfluenzaB__AGX21216

SEQ ID NO: 179995 - RNA, 1758 nt, Artificial Sequence; identical to SEQ ID NO: 179128
  derived and/or modified sequence opt4 from hemagglutinin__InfluenzaB__AGX21227

SEQ ID NO: 179996 - RNA, 1758 nt, Artificial Sequence
  derived and/or modified sequence opt4 from hemagglutinin__InfluenzaB__AGX21238
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccaacggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacaugaucagcagagacaacgugagcugcagcaucugccuguga

SEQ ID NO: 179997 - RNA, 1758 nt, Artificial Sequence; identical to SEQ ID NO: 179203
  derived and/or modified sequence opt4 from hemagglutinin__InfluenzaB__AGX21249

SEQ ID NO: 179998 - RNA, 1758 nt, Artificial Sequence
  derived and/or modified sequence opt4 from hemagglutinin__InfluenzaB__AGX21260
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179999 - RNA, 1758 nt, Artificial Sequence; identical to SEQ ID NO: 179128
  derived and/or modified sequence opt4 from hemagglutinin__InfluenzaB__AGX21271

SEQ ID NO: 180000 - RNA, 1758 nt, Artificial Sequence
  derived and/or modified sequence opt4 from hemagglutinin__InfluenzaB__AGX21282
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccagccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccaagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180001 - RNA, 1758 nt, Artificial Sequence; identical to SEQ ID NO: 179165
  derived and/or modified sequence opt4 from hemagglutinin__InfluenzaB__AGX21293

SEQ ID NO: 180002 - RNA, 1758 nt, Artificial Sequence; identical to SEQ ID NO: 179203
  derived and/or modified sequence opt4 from hemagglutinin__InfluenzaB__AGX21304

SEQ ID NO: 180003 - RNA, 1758 nt, Artificial Sequence; identical to SEQ ID NO: 179165
  derived and/or modified sequence opt4 from hemagglutinin__InfluenzaB__AGX21315

SEQ ID NO: 180004 - RNA, 1758 nt, Artificial Sequence; identical to SEQ ID NO: 179128
  derived and/or modified sequence opt4 from hemagglutinin__InfluenzaB__AGX21326

SEQ ID NO: 180005 - RNA, 1758 nt, Artificial Sequence
  derived and/or modified sequence opt4 from hemagglutinin__InfluenzaB__AGX21337
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaaggagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180006 - RNA, 1758 nt, Artificial Sequence; identical to SEQ ID NO: 179165
  derived and/or modified sequence opt4 from hemagglutinin__InfluenzaB__AGX21348

SEQ ID NO: 180007 - RNA, 1758 nt, Artificial Sequence; identical to SEQ ID NO: 179165
  derived and/or modified sequence opt4 from hemagglutinin__InfluenzaB__AGX21359

SEQ ID NO: 180008 - RNA, 1758 nt, Artificial Sequence
  derived and/or modified sequence opt4 from hemagglutinin__InfluenzaB__AGX21370
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaugggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180009 - RNA, 1758 nt, Artificial Sequence
  derived and/or modified sequence opt4 from hemagglutinin__InfluenzaB__AGX21381
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacaucagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180010 - RNA, 1758 nt, Artificial Sequence
  derived and/or modified sequence opt4 from hemagglutinin__InfluenzaB__AGX21392
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180011 - RNA, 1758 nt, Artificial Sequence
  derived and/or modified sequence opt4 from hemagglutinin__InfluenzaB__AGX21403
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccugaacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180012 - RNA, 1758 nt, Artificial Sequence
  derived and/or modified sequence opt4 from hemagglutinin__InfluenzaB__AGX21414
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccgacccccugaccaucgaggugcccuacaucugcaccgagggcgaggaccagaucaccguguggggcuuccacagcgacaacgagacccagauggccaagcuguacggcgacagcaagccccagaaguucaccagcagcagcaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180013 - RNA, 1758 nt, Artificial Sequence; identical to SEQ ID NO: 179128
  derived and/or modified sequence opt4 from hemagglutinin__InfluenzaB__AGX21425

SEQ ID NO: 180014 - RNA, 1758 nt, Artificial Sequence
  derived and/or modified sequence opt4 from hemagglutinin__InfluenzaB__AGX21436
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccguggccagcagccuggccgugacccugaugaucgccaucuucgugguguacauggugagcagagacaacgugagcugcagcaucugccuguga

SEQ ID NO: 180015 - RNA, 1758 nt, Artificial Sequence; identical to SEQ ID NO: 179203
  derived and/or modified sequence opt4 from hemagglutinin__InfluenzaB__AGX21447

SEQ ID NO: 180016 - RNA, 1758 nt, Artificial Sequence; identical to SEQ ID NO: 179128
  derived and/or modified sequence opt4 from hemagglutinin__InfluenzaB__AGX21458

SEQ ID NO: 180017 - RNA, 1758 nt, Artificial Sequence; identical to SEQ ID NO: 179128
  derived and/or modified sequence opt4 from hemagglutinin__InfluenzaB__AGX21469

SEQ ID NO: 180018 - RNA, 1758 nt, Artificial Sequence
  derived and/or modified sequence opt4 from hemagglutinin__InfluenzaB__AGX21480
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgaggacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180019 - RNA, 1758 nt, Artificial Sequence; identical to SEQ ID NO: 179203
  derived and/or modified sequence opt4 from hemagglutinin__InfluenzaB__AGX21491

SEQ ID NO: 180020 - RNA, 1758 nt, Artificial Sequence; identical to SEQ ID NO: 179203
  derived and/or modified sequence opt4 from hemagglutinin__InfluenzaB__AGX21502

SEQ ID NO: 180021 - RNA, 1758 nt, Artificial Sequence; identical to SEQ ID NO: 179128
  derived and/or modified sequence opt4 from hemagglutinin__InfluenzaB__AGX21513

SEQ ID NO: 180022 - RNA, 1758 nt, Artificial Sequence; identical to SEQ ID NO: 179165
  derived and/or modified sequence opt4 from hemagglutinin__InfluenzaB__AGX21524

SEQ ID NO: 180023 - RNA, 1758 nt, Artificial Sequence
  derived and/or modified sequence opt4 from hemagglutinin__InfluenzaB__AGX21535
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180024 - RNA, 1758 nt, Artificial Sequence; identical to SEQ ID NO: 179165
  derived and/or modified sequence opt4 from hemagglutinin__InfluenzaB__AGX21546

SEQ ID NO: 180025 - RNA, 1758 nt, Artificial Sequence
  derived and/or modified sequence opt4 from hemagglutinin__InfluenzaB__AGX21557
augaaggccaucaucgugcugcugaugguggugaccagcaacgccgacagaaucugcaccggcaucaccagcagcaacagcccccacguggugaagaccgccacccagggcgaggugaacgugaccggcgugaucacccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180026 - RNA, 1758 nt, Artificial Sequence
  derived and/or modified sequence opt4 from hemagglutinin__InfluenzaB__AGX21568
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaugaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180027 - RNA, 1758 nt, Artificial Sequence; identical to SEQ ID NO: 179128
  derived and/or modified sequence opt4 from hemagglutinin__InfluenzaB__AGX21579

SEQ ID NO: 180028 - RNA, 1758 nt, Artificial Sequence; identical to SEQ ID NO: 179165
  derived and/or modified sequence opt4 from hemagglutinin__InfluenzaB__AGX21590

SEQ ID NO: 180029 - RNA, 1758 nt, Artificial Sequence; identical to SEQ ID NO: 179978
  derived and/or modified sequence opt4 from hemagglutinin__InfluenzaB__AGX21601

SEQ ID NO: 180030 - RNA, 1758 nt, Artificial Sequence; identical to SEQ ID NO: 179165
  derived and/or modified sequence opt4 from hemagglutinin__InfluenzaB__AGX21611

SEQ ID NO: 180031 - RNA, 1758 nt, Artificial Sequence; identical to SEQ ID NO: 179509
  derived and/or modified sequence opt4 from hemagglutinin__InfluenzaB__AGX21622

SEQ ID NO: 180032 - RNA, 1758 nt, Artificial Sequence
  derived and/or modified sequence opt4 from hemagglutinin__InfluenzaB__AGX21633
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccagacugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180033 - RNA, 1758 nt, Artificial Sequence; identical to SEQ ID NO: 179203
  derived and/or modified sequence opt4 from hemagglutinin__InfluenzaB__AGX21644

SEQ ID NO: 180034 - RNA, 1758 nt, Artificial Sequence; identical to SEQ ID NO: 179128
  derived and/or modified sequence opt4 from hemagglutinin__InfluenzaB__AGX21655

SEQ ID NO: 180035 - RNA, 1758 nt, Artificial Sequence
  derived and/or modified sequence opt4 from hemagglutinin__InfluenzaB__AGX21666
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacaagaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180036 - RNA, 1758 nt, Artificial Sequence; identical to SEQ ID NO: 179203
  derived and/or modified sequence opt4 from hemagglutinin__InfluenzaB__AGX21677

SEQ ID NO: 180037 - RNA, 1758 nt, Artificial Sequence; identical to SEQ ID NO: 179128
  derived and/or modified sequence opt4 from hemagglutinin__InfluenzaB__AGX21688

SEQ ID NO: 180038 - RNA, 1758 nt, Artificial Sequence
  derived and/or modified sequence opt4 from hemagglutinin__InfluenzaB__AGX21699
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaaccuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugagcgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180039 - RNA, 1758 nt, Artificial Sequence; identical to SEQ ID NO: 179978
  derived and/or modified sequence opt4 from hemagglutinin__InfluenzaB__AGX21710

SEQ ID NO: 180040 - RNA, 1758 nt, Artificial Sequence; identical to SEQ ID NO: 179203
  derived and/or modified sequence opt4 from hemagglutinin__InfluenzaB__AGX21721

SEQ ID NO: 180041 - RNA, 1755 nt, Artificial Sequence
  derived and/or modified sequence opt4 from hemagglutinin__InfluenzaB__AGX21732
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcggccccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcgcccagaacgugaucaacgccgagaaggcccccggcggccccuacaagcugggcaccagcggcagcugccccaacgccaccagcaagagcggcuucuucgccaccauggccugggccgugcccagagacgacaacaagaccgccaccaacccccugaccguggaggugccccacaucugcgccaacgaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180042 - RNA, 1755 nt, Artificial Sequence
  derived and/or modified sequence opt4 from hemagglutinin__InfluenzaB__AGX21743
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccugggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcaagagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180043 - RNA, 1755 nt, Artificial Sequence
  derived and/or modified sequence opt4 from hemagglutinin__InfluenzaB__AGX21754
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccgccaagagccacuucgccaaccugaagggcaccaagaccagaggcaagcugugccccaccugccugaacugcaccgaccuggacguggcccugggcggccccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcgcccagaacgugaucaacgccgagaaggcccccggcggccccuacaagcugggcaccagcggcagcugccccaacgccaccagcaagagcggcuucuucgccaccauggccugggccgugcccagagacgacaacaagaccgccaccaacccccugaccguggaggugccccacaucugcgccaacgaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180044 - RNA, 1755 nt, Artificial Sequence
  derived and/or modified sequence opt4 from hemagglutinin__InfluenzaB__AGX21776
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180045 - RNA, 1758 nt, Artificial Sequence; identical to SEQ ID NO: 179499
  derived and/or modified sequence opt4 from hemagglutinin__InfluenzaB__AGX21787

SEQ ID NO: 180046 - RNA, 1755 nt, Artificial Sequence
  derived and/or modified sequence opt4 from hemagglutinin__InfluenzaB__AGX21798
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180047 - RNA, 1755 nt, Artificial Sequence
  derived and/or modified sequence opt4 from hemagglutinin__InfluenzaB__AGX21809
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcagacccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180048 - RNA, 1755 nt, Artificial Sequence
  derived and/or modified sequence opt4 from hemagglutinin__InfluenzaB__AGX21820
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccaacaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180049 - RNA, 1755 nt, Artificial Sequence; identical to SEQ ID NO: 179543
  derived and/or modified sequence opt4 from hemagglutinin__InfluenzaB__AGX21831

SEQ ID NO: 180050 - RNA, 1755 nt, Artificial Sequence; identical to SEQ ID NO: 179546
  derived and/or modified sequence opt4 from hemagglutinin__InfluenzaB__AGX21842

SEQ ID NO: 180051 - RNA, 1755 nt, Artificial Sequence; identical to SEQ ID NO: 179546
  derived and/or modified sequence opt4 from hemagglutinin__InfluenzaB__AGX21853

SEQ ID NO: 180052 - RNA, 1755 nt, Artificial Sequence
  derived and/or modified sequence opt4 from hemagglutinin__InfluenzaB__AGX21864
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcaaccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180053 - RNA, 1755 nt, Artificial Sequence; identical to SEQ ID NO: 179544
  derived and/or modified sequence opt4 from hemagglutinin__InfluenzaB__AGX21875

SEQ ID NO: 180054 - RNA, 1755 nt, Artificial Sequence; identical to SEQ ID NO: 179543
  derived and/or modified sequence opt4 from hemagglutinin__InfluenzaB__AGX21886

SEQ ID NO: 180055 - RNA, 1755 nt, Artificial Sequence; identical to SEQ ID NO: 179543
  derived and/or modified sequence opt4 from hemagglutinin__InfluenzaB__AGX21897

SEQ ID NO: 180056 - RNA, 1755 nt, Artificial Sequence; identical to SEQ ID NO: 179543
  derived and/or modified sequence opt4 from hemagglutinin__InfluenzaB__AGX21908

SEQ ID NO: 180057 - RNA, 1755 nt, Artificial Sequence
  derived and/or modified sequence opt4 from hemagglutinin__InfluenzaB__AGX21919
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaaggccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180058 - RNA, 1755 nt, Artificial Sequence; identical to SEQ ID NO: 179546
  derived and/or modified sequence opt4 from hemagglutinin__InfluenzaB__AGX21941

SEQ ID NO: 180059 - RNA, 1755 nt, Artificial Sequence; identical to SEQ ID NO: 179543
  derived and/or modified sequence opt4 from hemagglutinin__InfluenzaB__AGX21952

SEQ ID NO: 180060 - RNA, 1755 nt, Artificial Sequence; identical to SEQ ID NO: 179546
  derived and/or modified sequence opt4 from hemagglutinin__InfluenzaB__AGX21963

SEQ ID NO: 180061 - RNA, 1755 nt, Artificial Sequence
  derived and/or modified sequence opt4 from hemagglutinin__InfluenzaB__AGX21974
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggugaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacaugaucagcagagacaacgugagcugcagcaucugccuguga

SEQ ID NO: 180062 - RNA, 1755 nt, Artificial Sequence; identical to SEQ ID NO: 179546
  derived and/or modified sequence opt4 from hemagglutinin__InfluenzaB__AGX21985

SEQ ID NO: 180063 - RNA, 1755 nt, Artificial Sequence; identical to SEQ ID NO: 179544
  derived and/or modified sequence opt4 from hemagglutinin__InfluenzaB__AGX21996

SEQ ID NO: 180064 - RNA, 1755 nt, Artificial Sequence; identical to SEQ ID NO: 179544
  derived and/or modified sequence opt4 from hemagglutinin__InfluenzaB__AGX22007

SEQ ID NO: 180065 - RNA, 1755 nt, Artificial Sequence; identical to SEQ ID NO: 179543
  derived and/or modified sequence opt4 from hemagglutinin__InfluenzaB__AGX22018

SEQ ID NO: 180066 - RNA, 1755 nt, Artificial Sequence; identical to SEQ ID NO: 179543
  derived and/or modified sequence opt4 from hemagglutinin__InfluenzaB__AGX22029

SEQ ID NO: 180067 - RNA, 1755 nt, Artificial Sequence; identical to SEQ ID NO: 179543
  derived and/or modified sequence opt4 from hemagglutinin__InfluenzaB__AGX22040

SEQ ID NO: 180068 - RNA, 1755 nt, Artificial Sequence
  derived and/or modified sequence opt4 from hemagglutinin__InfluenzaB__AGX22051
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaucgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgcccugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180069 - RNA, 1755 nt, Artificial Sequence; identical to SEQ ID NO: 179543
  derived and/or modified sequence opt4 from hemagglutinin__InfluenzaB__AGX22062

SEQ ID NO: 180070 - RNA, 1755 nt, Artificial Sequence
  derived and/or modified sequence opt4 from hemagglutinin__InfluenzaB__AGX22073
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuucaucgagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgacuucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180071 - RNA, 1755 nt, Artificial Sequence; identical to SEQ ID NO: 179546
  derived and/or modified sequence opt4 from hemagglutinin__InfluenzaB__AGX22095

SEQ ID NO: 180072 - RNA, 1755 nt, Artificial Sequence; identical to SEQ ID NO: 179544
  derived and/or modified sequence opt4 from hemagglutinin__InfluenzaB__AGX22106

SEQ ID NO: 180073 - RNA, 1755 nt, Artificial Sequence
  derived and/or modified sequence opt4 from hemagglutinin__InfluenzaB__AGX22128
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggagaucaagaaccugcagagacugagcggcgccaugaacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180074 - RNA, 1755 nt, Artificial Sequence
  derived and/or modified sequence opt4 from hemagglutinin__InfluenzaB__AGX22139
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccgaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180075 - RNA, 1755 nt, Artificial Sequence; identical to SEQ ID NO: 180074
  derived and/or modified sequence opt4 from hemagglutinin__InfluenzaB__AGX22150

SEQ ID NO: 180076 - RNA, 1755 nt, Artificial Sequence; identical to SEQ ID NO: 180074
  derived and/or modified sequence opt4 from hemagglutinin__InfluenzaB__AGX22161

SEQ ID NO: 180077 - RNA, 1755 nt, Artificial Sequence; identical to SEQ ID NO: 179543
  derived and/or modified sequence opt4 from hemagglutinin__InfluenzaB__AGX22172

SEQ ID NO: 180078 - RNA, 1755 nt, Artificial Sequence; identical to SEQ ID NO: 180074
  derived and/or modified sequence opt4 from hemagglutinin__InfluenzaB__AGX22183

SEQ ID NO: 180079 - RNA, 1755 nt, Artificial Sequence; identical to SEQ ID NO: 180074
  derived and/or modified sequence opt4 from hemagglutinin__InfluenzaB__AGX22194

SEQ ID NO: 180080 - RNA, 1755 nt, Artificial Sequence; identical to SEQ ID NO: 180074
  derived and/or modified sequence opt4 from hemagglutinin__InfluenzaB__AGX22205

SEQ ID NO: 180081 - RNA, 1755 nt, Artificial Sequence; identical to SEQ ID NO: 179544
  derived and/or modified sequence opt4 from hemagglutinin__InfluenzaB__AGX22216

SEQ ID NO: 180082 - RNA, 1755 nt, Artificial Sequence; identical to SEQ ID NO: 179546
  derived and/or modified sequence opt4 from hemagglutinin__InfluenzaB__AGX22227

SEQ ID NO: 180083 - RNA, 1755 nt, Artificial Sequence
  derived and/or modified sequence opt4 from hemagglutinin__InfluenzaB__AGX22238
augaaggccaucaucgugcugcugaugguggugaccagcaacgccgacagaaucugcaccggcaucaccagcagcaacagcccccacauggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180084 - RNA, 1755 nt, Artificial Sequence; identical to SEQ ID NO: 179544
  derived and/or modified sequence opt4 from hemagglutinin__InfluenzaB__AGX22249

SEQ ID NO: 180085 - RNA, 1755 nt, Artificial Sequence; identical to SEQ ID NO: 179543
  derived and/or modified sequence opt4 from hemagglutinin__InfluenzaB__AGX22260

SEQ ID NO: 180086 - RNA, 1755 nt, Artificial Sequence
  derived and/or modified sequence opt4 from hemagglutinin__InfluenzaB__AGX22271
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagacccagcgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180087 - RNA, 1755 nt, Artificial Sequence
  derived and/or modified sequence opt4 from hemagglutinin__InfluenzaB__AGX22282
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180088 - RNA, 1755 nt, Artificial Sequence; identical to SEQ ID NO: 179543
  derived and/or modified sequence opt4 from hemagglutinin__InfluenzaB__AGX22293

SEQ ID NO: 180089 - RNA, 1755 nt, Artificial Sequence
  derived and/or modified sequence opt4 from hemagglutinin__InfluenzaB__AGX22304
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcaccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180090 - RNA, 1755 nt, Artificial Sequence; identical to SEQ ID NO: 179543
  derived and/or modified sequence opt4 from hemagglutinin__InfluenzaB__AGX22315

SEQ ID NO: 180091 - RNA, 1755 nt, Artificial Sequence; identical to SEQ ID NO: 178946
  derived and/or modified sequence opt4 from hemagglutinin__InfluenzaB__AGX22326

SEQ ID NO: 180092 - RNA, 1755 nt, Artificial Sequence; identical to SEQ ID NO: 179546
  derived and/or modified sequence opt4 from hemagglutinin__InfluenzaB__AGX22337

SEQ ID NO: 180093 - RNA, 1755 nt, Artificial Sequence; identical to SEQ ID NO: 179546
  derived and/or modified sequence opt4 from hemagglutinin__InfluenzaB__AGX22348

SEQ ID NO: 180094 - RNA, 1755 nt, Artificial Sequence
  derived and/or modified sequence opt4 from hemagglutinin__InfluenzaB__AGX22359
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccaagaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggagaucaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180095 - RNA, 1755 nt, Artificial Sequence; identical to SEQ ID NO: 179544
  derived and/or modified sequence opt4 from hemagglutinin__InfluenzaB__AGX22370

SEQ ID NO: 180096 - RNA, 1755 nt, Artificial Sequence
  derived and/or modified sequence opt4 from hemagglutinin__InfluenzaB__AGX22381
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugagcaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180097 - RNA, 1755 nt, Artificial Sequence; identical to SEQ ID NO: 179543
  derived and/or modified sequence opt4 from hemagglutinin__InfluenzaB__AGX22392

SEQ ID NO: 180098 - RNA, 1755 nt, Artificial Sequence
  derived and/or modified sequence opt4 from hemagglutinin__InfluenzaB__AGX22403
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgacuucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180099 - RNA, 1755 nt, Artificial Sequence; identical to SEQ ID NO: 179543
  derived and/or modified sequence opt4 from hemagglutinin__InfluenzaB__AGX22414

SEQ ID NO: 180100 - RNA, 1755 nt, Artificial Sequence
  derived and/or modified sequence opt4 from hemagglutinin__InfluenzaB__AGX22425
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180101 - RNA, 1755 nt, Artificial Sequence; identical to SEQ ID NO: 179544
  derived and/or modified sequence opt4 from hemagglutinin__InfluenzaB__AGX22436

SEQ ID NO: 180102 - RNA, 1755 nt, Artificial Sequence; identical to SEQ ID NO: 179544
  derived and/or modified sequence opt4 from hemagglutinin__InfluenzaB__AGX22445

SEQ ID NO: 180103 - RNA, 1755 nt, Artificial Sequence
  derived and/or modified sequence opt4 from hemagglutinin__InfluenzaB__AGX22456
augaaggccaucaucgugcugcugaugguggugaccagcaacgccgacagaaucugcaccggcaucaccagcagcagcagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacagcgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacaucgugagcagagacaacgugagcugcagcaucugccuguga

SEQ ID NO: 180104 - RNA, 1755 nt, Artificial Sequence; identical to SEQ ID NO: 179543
  derived and/or modified sequence opt4 from hemagglutinin__InfluenzaB__AGX22467

SEQ ID NO: 180105 - RNA, 1755 nt, Artificial Sequence; identical to SEQ ID NO: 179543
  derived and/or modified sequence opt4 from hemagglutinin__InfluenzaB__AGX22478

SEQ ID NO: 180106 - RNA, 1755 nt, Artificial Sequence
  derived and/or modified sequence opt4 from hemagglutinin__InfluenzaB__AGX22489
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagagcgccaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccggccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcgcccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180107 - RNA, 1755 nt, Artificial Sequence
  derived and/or modified sequence opt4 from hemagglutinin__InfluenzaB__AGX22500
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgcccagaccgaggacggcggccugccccagagcggcagaaucaucguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccguggccagcagccuggccgugacccugaugcuggccaucuucaucguguacauggugagcagagacaacgugagcugcagcaucugccuguga

SEQ ID NO: 180108 - RNA, 1755 nt, Artificial Sequence; identical to SEQ ID NO: 179544
  derived and/or modified sequence opt4 from hemagglutinin__InfluenzaB__AGX22511

SEQ ID NO: 180109 - RNA, 1755 nt, Artificial Sequence
  derived and/or modified sequence opt4 from hemagglutinin__InfluenzaB__AGX22522
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccaagcacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180110 - RNA, 1755 nt, Artificial Sequence; identical to SEQ ID NO: 178946
  derived and/or modified sequence opt4 from hemagglutinin__InfluenzaB__AGX22533

SEQ ID NO: 180111 - RNA, 1755 nt, Artificial Sequence; identical to SEQ ID NO: 179558
  derived and/or modified sequence opt4 from hemagglutinin__InfluenzaB__AGX22566

SEQ ID NO: 180112 - RNA, 1755 nt, Artificial Sequence; identical to SEQ ID NO: 179544
  derived and/or modified sequence opt4 from hemagglutinin__InfluenzaB__AGX22577

SEQ ID NO: 180113 - RNA, 1755 nt, Artificial Sequence; identical to SEQ ID NO: 179558
  derived and/or modified sequence opt4 from hemagglutinin__InfluenzaB__AGX22588

SEQ ID NO: 180114 - RNA, 1755 nt, Artificial Sequence; identical to SEQ ID NO: 178946
  derived and/or modified sequence opt4 from hemagglutinin__InfluenzaB__AGX22599

SEQ ID NO: 180115 - RNA, 1755 nt, Artificial Sequence
  derived and/or modified sequence opt4 from hemagglutinin__InfluenzaB__AGX22610
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgaccccaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180116 - RNA, 1755 nt, Artificial Sequence
  derived and/or modified sequence opt4 from hemagglutinin__InfluenzaB__AGX22621
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccggcggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180117 - RNA, 1755 nt, Artificial Sequence; identical to SEQ ID NO: 178946
  derived and/or modified sequence opt4 from hemagglutinin__InfluenzaB__AGX22632

SEQ ID NO: 180118 - RNA, 1755 nt, Artificial Sequence
  derived and/or modified sequence opt4 from hemagglutinin__InfluenzaB__AGX22643
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcauccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180119 - RNA, 1755 nt, Artificial Sequence
  derived and/or modified sequence opt4 from hemagglutinin__InfluenzaB__AGX22654
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacagcgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180120 - RNA, 1755 nt, Artificial Sequence; identical to SEQ ID NO: 179558
  derived and/or modified sequence opt4 from hemagglutinin__InfluenzaB__AGX22665

SEQ ID NO: 180121 - RNA, 1755 nt, Artificial Sequence; identical to SEQ ID NO: 179558
  derived and/or modified sequence opt4 from hemagglutinin__InfluenzaB__AGX22676

SEQ ID NO: 180122 - RNA, 1755 nt, Artificial Sequence; identical to SEQ ID NO: 178946
  derived and/or modified sequence opt4 from hemagglutinin__InfluenzaB__AGX22687

SEQ ID NO: 180123 - RNA, 1755 nt, Artificial Sequence; identical to SEQ ID NO: 179558
  derived and/or modified sequence opt4 from hemagglutinin__InfluenzaB__AGX22698

SEQ ID NO: 180124 - RNA, 1755 nt, Artificial Sequence
  derived and/or modified sequence opt4 from hemagglutinin__InfluenzaB__AGX22709
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccgagaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180125 - RNA, 1755 nt, Artificial Sequence
  derived and/or modified sequence opt4 from hemagglutinin__InfluenzaB__AGX22720
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgccaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180126 - RNA, 1755 nt, Artificial Sequence; identical to SEQ ID NO: 179558
  derived and/or modified sequence opt4 from hemagglutinin__InfluenzaB__AGX22731

SEQ ID NO: 180127 - RNA, 1755 nt, Artificial Sequence; identical to SEQ ID NO: 180119
  derived and/or modified sequence opt4 from hemagglutinin__InfluenzaB__AGX22742

SEQ ID NO: 180128 - RNA, 1755 nt, Artificial Sequence
  derived and/or modified sequence opt4 from hemagglutinin__InfluenzaB__AGX22753
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccgccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180129 - RNA, 1755 nt, Artificial Sequence
  derived and/or modified sequence opt4 from hemagglutinin__InfluenzaB__AGX22764
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgaccacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180130 - RNA, 1755 nt, Artificial Sequence
  derived and/or modified sequence opt4 from hemagglutinin__InfluenzaB__AGX22775
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaagacugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180131 - RNA, 1755 nt, Artificial Sequence; identical to SEQ ID NO: 179558
  derived and/or modified sequence opt4 from hemagglutinin__InfluenzaB__AGX22786

SEQ ID NO: 180132 - RNA, 1755 nt, Artificial Sequence
  derived and/or modified sequence opt4 from hemagglutinin__InfluenzaB__AGX22797
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcuguucccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180133 - RNA, 1755 nt, Artificial Sequence; identical to SEQ ID NO: 179558
  derived and/or modified sequence opt4 from hemagglutinin__InfluenzaB__AGX22808

SEQ ID NO: 180134 - RNA, 1755 nt, Artificial Sequence; identical to SEQ ID NO: 179558
  derived and/or modified sequence opt4 from hemagglutinin__InfluenzaB__AGX22819

SEQ ID NO: 180135 - RNA, 1755 nt, Artificial Sequence; identical to SEQ ID NO: 179558
  derived and/or modified sequence opt4 from hemagglutinin__InfluenzaB__AGX22830

SEQ ID NO: 180136 - RNA, 1755 nt, Artificial Sequence
  derived and/or modified sequence opt4 from hemagglutinin__InfluenzaB__AGX22841
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccgacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180137 - RNA, 1755 nt, Artificial Sequence; identical to SEQ ID NO: 178946
  derived and/or modified sequence opt4 from hemagglutinin__InfluenzaB__AGX22852

SEQ ID NO: 180138 - RNA, 1755 nt, Artificial Sequence; identical to SEQ ID NO: 179558
  derived and/or modified sequence opt4 from hemagglutinin__InfluenzaB__AGX22863

SEQ ID NO: 180139 - RNA, 1755 nt, Artificial Sequence; identical to SEQ ID NO: 179558
  derived and/or modified sequence opt4 from hemagglutinin__InfluenzaB__AGX22874

SEQ ID NO: 180140 - RNA, 1755 nt, Artificial Sequence; identical to SEQ ID NO: 178946
  derived and/or modified sequence opt4 from hemagglutinin__InfluenzaB__AGX22885

SEQ ID NO: 180141 - RNA, 1755 nt, Artificial Sequence; identical to SEQ ID NO: 180119
  derived and/or modified sequence opt4 from hemagglutinin__InfluenzaB__AGX22896

SEQ ID NO: 180142 - RNA, 1755 nt, Artificial Sequence
  derived and/or modified sequence opt4 from hemagglutinin__InfluenzaB__AGX22907
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacagcgugagcugcagcaucugccuguga

SEQ ID NO: 180143 - RNA, 1755 nt, Artificial Sequence; identical to SEQ ID NO: 178946
  derived and/or modified sequence opt4 from hemagglutinin__InfluenzaB__AGX22918

SEQ ID NO: 180144 - RNA, 1755 nt, Artificial Sequence; identical to SEQ ID NO: 178946
  derived and/or modified sequence opt4 from hemagglutinin__InfluenzaB__AGX22929

SEQ ID NO: 180145 - RNA, 1755 nt, Artificial Sequence; identical to SEQ ID NO: 179558
  derived and/or modified sequence opt4 from hemagglutinin__InfluenzaB__AGX22940

SEQ ID NO: 180146 - RNA, 1755 nt, Artificial Sequence; identical to SEQ ID NO: 178946
  derived and/or modified sequence opt4 from hemagglutinin__InfluenzaB__AGX22951

SEQ ID NO: 180147 - RNA, 1755 nt, Artificial Sequence; identical to SEQ ID NO: 178946
  derived and/or modified sequence opt4 from hemagglutinin__InfluenzaB__AGX22962

SEQ ID NO: 180148 - RNA, 1755 nt, Artificial Sequence; identical to SEQ ID NO: 178946
  derived and/or modified sequence opt4 from hemagglutinin__InfluenzaB__AGX22973

SEQ ID NO: 180149 - RNA, 1755 nt, Artificial Sequence; identical to SEQ ID NO: 178946
  derived and/or modified sequence opt4 from hemagglutinin__InfluenzaB__AGX22984

SEQ ID NO: 180150 - RNA, 1755 nt, Artificial Sequence; identical to SEQ ID NO: 178946
  derived and/or modified sequence opt4 from hemagglutinin__InfluenzaB__AGX22995

SEQ ID NO: 180151 - RNA, 1755 nt, Artificial Sequence; identical to SEQ ID NO: 178946
  derived and/or modified sequence opt4 from hemagglutinin__InfluenzaB__AGX23006

SEQ ID NO: 180152 - RNA, 1755 nt, Artificial Sequence
  derived and/or modified sequence opt4 from hemagglutinin__InfluenzaB__AGX23017
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgagaucagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180153 - RNA, 1755 nt, Artificial Sequence
  derived and/or modified sequence opt4 from hemagglutinin__InfluenzaB__AGX23028
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacaagcugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180154 - RNA, 1755 nt, Artificial Sequence; identical to SEQ ID NO: 178946
  derived and/or modified sequence opt4 from hemagglutinin__InfluenzaB__AGX23039

SEQ ID NO: 180155 - RNA, 1755 nt, Artificial Sequence
  derived and/or modified sequence opt4 from hemagglutinin__InfluenzaB__AGX23050
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagccccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugagacuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180156 - RNA, 1755 nt, Artificial Sequence
  derived and/or modified sequence opt4 from hemagglutinin__InfluenzaB__AGX23061
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugagacuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180157 - RNA, 1755 nt, Artificial Sequence; identical to SEQ ID NO: 178946
  derived and/or modified sequence opt4 from hemagglutinin__InfluenzaB__AGX23072

SEQ ID NO: 180158 - RNA, 1755 nt, Artificial Sequence; identical to SEQ ID NO: 179558
  derived and/or modified sequence opt4 from hemagglutinin__InfluenzaB__AGX23083

SEQ ID NO: 180159 - RNA, 1755 nt, Artificial Sequence; identical to SEQ ID NO: 178946
  derived and/or modified sequence opt4 from hemagglutinin__InfluenzaB__AGX23094

SEQ ID NO: 180160 - RNA, 1755 nt, Artificial Sequence; identical to SEQ ID NO: 178946
  derived and/or modified sequence opt4 from hemagglutinin__InfluenzaB__AGX23105

SEQ ID NO: 180161 - RNA, 1755 nt, Artificial Sequence; identical to SEQ ID NO: 179558
  derived and/or modified sequence opt4 from hemagglutinin__InfluenzaB__AGX23116

SEQ ID NO: 180162 - RNA, 1755 nt, Artificial Sequence; identical to SEQ ID NO: 178946
  derived and/or modified sequence opt4 from hemagglutinin__InfluenzaB__AGX23127

SEQ ID NO: 180163 - RNA, 1755 nt, Artificial Sequence; identical to SEQ ID NO: 178946
  derived and/or modified sequence opt4 from hemagglutinin__InfluenzaB__AGX23138

SEQ ID NO: 180164 - RNA, 1755 nt, Artificial Sequence
  derived and/or modified sequence opt4 from hemagglutinin__InfluenzaB__AGX23149
augaaggccaucaucgugcugcugaugguggugaccagcaacgccgacagaaucugcaccggcaucaccagcagcgacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180165 - RNA, 1755 nt, Artificial Sequence
  derived and/or modified sequence opt4 from hemagglutinin__InfluenzaB__AGX23160
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagagauucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugagacuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180166 - RNA, 1755 nt, Artificial Sequence
  derived and/or modified sequence opt4 from hemagglutinin__InfluenzaB__AGX23171
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagagauucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugagacuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180167 - RNA, 1755 nt, Artificial Sequence; identical to SEQ ID NO: 178946
  derived and/or modified sequence opt4 from hemagglutinin__InfluenzaB__AGX23182

SEQ ID NO: 180168 - RNA, 1755 nt, Artificial Sequence; identical to SEQ ID NO: 178946
  derived and/or modified sequence opt4 from hemagglutinin__InfluenzaB__AGX23193

SEQ ID NO: 180169 - RNA, 1755 nt, Artificial Sequence; identical to SEQ ID NO: 179558
  derived and/or modified sequence opt4 from hemagglutinin__InfluenzaB__AGX23204

SEQ ID NO: 180170 - RNA, 1755 nt, Artificial Sequence; identical to SEQ ID NO: 178946
  derived and/or modified sequence opt4 from hemagglutinin__InfluenzaB__AGX23215

SEQ ID NO: 180171 - RNA, 1755 nt, Artificial Sequence
  derived and/or modified sequence opt4 from hemagglutinin__InfluenzaB__AGX23226
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccagcggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180172 - RNA, 1755 nt, Artificial Sequence; identical to SEQ ID NO: 180119
  derived and/or modified sequence opt4 from hemagglutinin__InfluenzaB__AGX23237

SEQ ID NO: 180173 - RNA, 1755 nt, Artificial Sequence
  derived and/or modified sequence opt4 from hemagglutinin__InfluenzaB__AGX23248
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccagcggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccugaacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180174 - RNA, 1755 nt, Artificial Sequence; identical to SEQ ID NO: 178946
  derived and/or modified sequence opt4 from hemagglutinin__InfluenzaB__AGX23259

SEQ ID NO: 180175 - RNA, 1755 nt, Artificial Sequence; identical to SEQ ID NO: 178946
  derived and/or modified sequence opt4 from hemagglutinin__InfluenzaB__AGX23270

SEQ ID NO: 180176 - RNA, 1755 nt, Artificial Sequence
  derived and/or modified sequence opt4 from hemagglutinin__InfluenzaB__AGX23281
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccgccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacagcgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180177 - RNA, 1755 nt, Artificial Sequence
  derived and/or modified sequence opt4 from hemagglutinin__InfluenzaB__AGX23292
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaacagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180178 - RNA, 1755 nt, Artificial Sequence
  derived and/or modified sequence opt4 from hemagglutinin__InfluenzaB__AGX23314
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagagagcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180179 - RNA, 1755 nt, Artificial Sequence; identical to SEQ ID NO: 180178
  derived and/or modified sequence opt4 from hemagglutinin__InfluenzaB__AGX23325

SEQ ID NO: 180180 - RNA, 1755 nt, Artificial Sequence; identical to SEQ ID NO: 180178
  derived and/or modified sequence opt4 from hemagglutinin__InfluenzaB__AGX23336

SEQ ID NO: 180181 - RNA, 1755 nt, Artificial Sequence; identical to SEQ ID NO: 180178
  derived and/or modified sequence opt4 from hemagglutinin__InfluenzaB__AGX23347

SEQ ID NO: 180182 - RNA, 1755 nt, Artificial Sequence; identical to SEQ ID NO: 180178
  derived and/or modified sequence opt4 from hemagglutinin__InfluenzaB__AGX23358

SEQ ID NO: 180183 - RNA, 1755 nt, Artificial Sequence; identical to SEQ ID NO: 180178
  derived and/or modified sequence opt4 from hemagglutinin__InfluenzaB__AGX23369

SEQ ID NO: 180184 - RNA, 1755 nt, Artificial Sequence; identical to SEQ ID NO: 180178
  derived and/or modified sequence opt4 from hemagglutinin__InfluenzaB__AGX23380

SEQ ID NO: 180185 - RNA, 1755 nt, Artificial Sequence; identical to SEQ ID NO: 178946
  derived and/or modified sequence opt4 from hemagglutinin__InfluenzaB__AGX23391

SEQ ID NO: 180186 - RNA, 1755 nt, Artificial Sequence
  derived and/or modified sequence opt4 from hemagglutinin__InfluenzaB__AGX23413
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcaaccagaacgugaucgacgccgagagagcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180187 - RNA, 1755 nt, Artificial Sequence; identical to SEQ ID NO: 180186
  derived and/or modified sequence opt4 from hemagglutinin__InfluenzaB__AGX23424

SEQ ID NO: 180188 - RNA, 1755 nt, Artificial Sequence; identical to SEQ ID NO: 179340
  derived and/or modified sequence opt4 from hemagglutinin__InfluenzaB__AGX23435

SEQ ID NO: 180189 - RNA, 1755 nt, Artificial Sequence; identical to SEQ ID NO: 179251
  derived and/or modified sequence opt4 from hemagglutinin__InfluenzaB__AGX23446

SEQ ID NO: 180190 - RNA, 1755 nt, Artificial Sequence; identical to SEQ ID NO: 179340
  derived and/or modified sequence opt4 from hemagglutinin__InfluenzaB__AGX23457

SEQ ID NO: 180191 - RNA, 1755 nt, Artificial Sequence; identical to SEQ ID NO: 179251
  derived and/or modified sequence opt4 from hemagglutinin__InfluenzaB__AGX23468

SEQ ID NO: 180192 - RNA, 1755 nt, Artificial Sequence; identical to SEQ ID NO: 178946
  derived and/or modified sequence opt4 from hemagglutinin__InfluenzaB__AGX23479

SEQ ID NO: 180193 - RNA, 1755 nt, Artificial Sequence; identical to SEQ ID NO: 178946
  derived and/or modified sequence opt4 from hemagglutinin__InfluenzaB__AGX23490

SEQ ID NO: 180194 - RNA, 1755 nt, Artificial Sequence; identical to SEQ ID NO: 179567
  derived and/or modified sequence opt4 from hemagglutinin__InfluenzaB__AGX23501

SEQ ID NO: 180195 - RNA, 1755 nt, Artificial Sequence
  derived and/or modified sequence opt4 from hemagglutinin__InfluenzaB__AGX23512
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagacccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180196 - RNA, 1755 nt, Artificial Sequence; identical to SEQ ID NO: 178946
  derived and/or modified sequence opt4 from hemagglutinin__InfluenzaB__AGX23523

SEQ ID NO: 180197 - RNA, 1755 nt, Artificial Sequence; identical to SEQ ID NO: 179251
  derived and/or modified sequence opt4 from hemagglutinin__InfluenzaB__AGX23534

SEQ ID NO: 180198 - RNA, 1755 nt, Artificial Sequence; identical to SEQ ID NO: 179251
  derived and/or modified sequence opt4 from hemagglutinin__InfluenzaB__AGX23545

SEQ ID NO: 180199 - RNA, 1755 nt, Artificial Sequence; identical to SEQ ID NO: 178946
  derived and/or modified sequence opt4 from hemagglutinin__InfluenzaB__AGX23556

SEQ ID NO: 180200 - RNA, 1755 nt, Artificial Sequence; identical to SEQ ID NO: 178946
  derived and/or modified sequence opt4 from hemagglutinin__InfluenzaB__AGX23567

SEQ ID NO: 180201 - RNA, 1755 nt, Artificial Sequence; identical to SEQ ID NO: 178946
  derived and/or modified sequence opt4 from hemagglutinin__InfluenzaB__AGX23578

SEQ ID NO: 180202 - RNA, 1755 nt, Artificial Sequence; identical to SEQ ID NO: 178946
  derived and/or modified sequence opt4 from hemagglutinin__InfluenzaB__AGX23600

SEQ ID NO: 180203 - RNA, 1755 nt, Artificial Sequence
  derived and/or modified sequence opt4 from hemagglutinin__InfluenzaB__AGX23611
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggagaucaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180204 - RNA, 1755 nt, Artificial Sequence; identical to SEQ ID NO: 178946
  derived and/or modified sequence opt4 from hemagglutinin__InfluenzaB__AGX23622

SEQ ID NO: 180205 - RNA, 1755 nt, Artificial Sequence; identical to SEQ ID NO: 179251
  derived and/or modified sequence opt4 from hemagglutinin__InfluenzaB__AGX23633

SEQ ID NO: 180206 - RNA, 1755 nt, Artificial Sequence; identical to SEQ ID NO: 179251
  derived and/or modified sequence opt4 from hemagglutinin__InfluenzaB__AGX23644

SEQ ID NO: 180207 - RNA, 1755 nt, Artificial Sequence; identical to SEQ ID NO: 178946
  derived and/or modified sequence opt4 from hemagglutinin__InfluenzaB__AGX23655

SEQ ID NO: 180208 - RNA, 1755 nt, Artificial Sequence; identical to SEQ ID NO: 179251
  derived and/or modified sequence opt4 from hemagglutinin__InfluenzaB__AGX23666

SEQ ID NO: 180209 - RNA, 1755 nt, Artificial Sequence
  derived and/or modified sequence opt4 from hemagglutinin__InfluenzaB__AGX23677
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaucgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180210 - RNA, 1755 nt, Artificial Sequence; identical to SEQ ID NO: 179251
  derived and/or modified sequence opt4 from hemagglutinin__InfluenzaB__AGX23688

SEQ ID NO: 180211 - RNA, 1755 nt, Artificial Sequence; identical to SEQ ID NO: 179251
  derived and/or modified sequence opt4 from hemagglutinin__InfluenzaB__AGX23699

SEQ ID NO: 180212 - RNA, 1755 nt, Artificial Sequence; identical to SEQ ID NO: 178946
  derived and/or modified sequence opt4 from hemagglutinin__InfluenzaB__AGX23710

SEQ ID NO: 180213 - RNA, 1755 nt, Artificial Sequence; identical to SEQ ID NO: 179251
  derived and/or modified sequence opt4 from hemagglutinin__InfluenzaB__AGX23721

SEQ ID NO: 180214 - RNA, 1755 nt, Artificial Sequence; identical to SEQ ID NO: 178946
  derived and/or modified sequence opt4 from hemagglutinin__InfluenzaB__AGX23732

SEQ ID NO: 180215 - RNA, 1755 nt, Artificial Sequence; identical to SEQ ID NO: 179251
  derived and/or modified sequence opt4 from hemagglutinin__InfluenzaB__AGX23743

SEQ ID NO: 180216 - RNA, 1755 nt, Artificial Sequence; identical to SEQ ID NO: 179251
  derived and/or modified sequence opt4 from hemagglutinin__InfluenzaB__AGX23754

SEQ ID NO: 180217 - RNA, 1755 nt, Artificial Sequence; identical to SEQ ID NO: 178946
  derived and/or modified sequence opt4 from hemagglutinin__InfluenzaB__AGX23765

SEQ ID NO: 180218 - RNA, 1755 nt, Artificial Sequence; identical to SEQ ID NO: 179251
  derived and/or modified sequence opt4 from hemagglutinin__InfluenzaB__AGX23776

SEQ ID NO: 180219 - RNA, 1755 nt, Artificial Sequence; identical to SEQ ID NO: 179251
  derived and/or modified sequence opt4 from hemagglutinin__InfluenzaB__AGX23787

SEQ ID NO: 180220 - RNA, 1755 nt, Artificial Sequence; identical to SEQ ID NO: 178946
  derived and/or modified sequence opt4 from hemagglutinin__InfluenzaB__AGX23798

SEQ ID NO: 180221 - RNA, 1755 nt, Artificial Sequence; identical to SEQ ID NO: 178946
  derived and/or modified sequence opt4 from hemagglutinin__InfluenzaB__AGX23809

SEQ ID NO: 180222 - RNA, 1755 nt, Artificial Sequence; identical to SEQ ID NO: 178946
  derived and/or modified sequence opt4 from hemagglutinin__InfluenzaB__AGX23820

SEQ ID NO: 180223 - RNA, 1755 nt, Artificial Sequence; identical to SEQ ID NO: 179251
  derived and/or modified sequence opt4 from hemagglutinin__InfluenzaB__AGX23831

SEQ ID NO: 180224 - RNA, 1755 nt, Artificial Sequence; identical to SEQ ID NO: 178946
  derived and/or modified sequence opt4 from hemagglutinin__InfluenzaB__AGX23842

SEQ ID NO: 180225 - RNA, 1755 nt, Artificial Sequence
  derived and/or modified sequence opt4 from hemagglutinin__InfluenzaB__AGX23853
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcauccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagagcggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180226 - RNA, 1755 nt, Artificial Sequence; identical to SEQ ID NO: 178946
  derived and/or modified sequence opt4 from hemagglutinin__InfluenzaB__AGX23864

SEQ ID NO: 180227 - RNA, 1755 nt, Artificial Sequence; identical to SEQ ID NO: 179251
  derived and/or modified sequence opt4 from hemagglutinin__InfluenzaB__AGX23875

SEQ ID NO: 180228 - RNA, 1755 nt, Artificial Sequence; identical to SEQ ID NO: 178946
  derived and/or modified sequence opt4 from hemagglutinin__InfluenzaB__AGX23886

SEQ ID NO: 180229 - RNA, 1755 nt, Artificial Sequence
  derived and/or modified sequence opt4 from hemagglutinin__InfluenzaB__AGX23897
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagagcggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180230 - RNA, 1755 nt, Artificial Sequence
  derived and/or modified sequence opt4 from hemagglutinin__InfluenzaB__AGX23908
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgugaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180231 - RNA, 1755 nt, Artificial Sequence; identical to SEQ ID NO: 179087
  derived and/or modified sequence opt4 from hemagglutinin__InfluenzaB__AGX23919

SEQ ID NO: 180232 - RNA, 1755 nt, Artificial Sequence; identical to SEQ ID NO: 179567
  derived and/or modified sequence opt4 from hemagglutinin__InfluenzaB__AGX23930

SEQ ID NO: 180233 - RNA, 1755 nt, Artificial Sequence; identical to SEQ ID NO: 178946
  derived and/or modified sequence opt4 from hemagglutinin__InfluenzaB__AGX23941

SEQ ID NO: 180234 - RNA, 1755 nt, Artificial Sequence; identical to SEQ ID NO: 179251
  derived and/or modified sequence opt4 from hemagglutinin__InfluenzaB__AGX23952

SEQ ID NO: 180235 - RNA, 1755 nt, Artificial Sequence; identical to SEQ ID NO: 179251
  derived and/or modified sequence opt4 from hemagglutinin__InfluenzaB__AGX23963

SEQ ID NO: 180236 - RNA, 1755 nt, Artificial Sequence; identical to SEQ ID NO: 179567
  derived and/or modified sequence opt4 from hemagglutinin__InfluenzaB__AGX23974

SEQ ID NO: 180237 - RNA, 1755 nt, Artificial Sequence; identical to SEQ ID NO: 179087
  derived and/or modified sequence opt4 from hemagglutinin__InfluenzaB__AGX23985

SEQ ID NO: 180238 - RNA, 1755 nt, Artificial Sequence
  derived and/or modified sequence opt4 from hemagglutinin__InfluenzaB__AGX23996
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccaucaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180239 - RNA, 1755 nt, Artificial Sequence; identical to SEQ ID NO: 179567
  derived and/or modified sequence opt4 from hemagglutinin__InfluenzaB__AGX24007

SEQ ID NO: 180240 - RNA, 1755 nt, Artificial Sequence; identical to SEQ ID NO: 179567
  derived and/or modified sequence opt4 from hemagglutinin__InfluenzaB__AGX24018

SEQ ID NO: 180241 - RNA, 1755 nt, Artificial Sequence
  derived and/or modified sequence opt4 from hemagglutinin__InfluenzaB__AGX24029
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccugaacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180242 - RNA, 1755 nt, Artificial Sequence; identical to SEQ ID NO: 179567
  derived and/or modified sequence opt4 from hemagglutinin__InfluenzaB__AGX24040

SEQ ID NO: 180243 - RNA, 1755 nt, Artificial Sequence; identical to SEQ ID NO: 179251
  derived and/or modified sequence opt4 from hemagglutinin__InfluenzaB__AGX24051

SEQ ID NO: 180244 - RNA, 1755 nt, Artificial Sequence; identical to SEQ ID NO: 179340
  derived and/or modified sequence opt4 from hemagglutinin__InfluenzaB__AGX24062

SEQ ID NO: 180245 - RNA, 1755 nt, Artificial Sequence; identical to SEQ ID NO: 179087
  derived and/or modified sequence opt4 from hemagglutinin__InfluenzaB__AGX24073

SEQ ID NO: 180246 - RNA, 1755 nt, Artificial Sequence
  derived and/or modified sequence opt4 from hemagglutinin__InfluenzaB__AGX24084
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcaucauccacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180247 - RNA, 1755 nt, Artificial Sequence; identical to SEQ ID NO: 179567
  derived and/or modified sequence opt4 from hemagglutinin__InfluenzaB__AGX24095

SEQ ID NO: 180248 - RNA, 1755 nt, Artificial Sequence
  derived and/or modified sequence opt4 from hemagglutinin__InfluenzaB__AGX24106
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacaccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180249 - RNA, 1755 nt, Artificial Sequence
  derived and/or modified sequence opt4 from hemagglutinin__InfluenzaB__AGX24117
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacaccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180250 - RNA, 1755 nt, Artificial Sequence
  derived and/or modified sequence opt4 from hemagglutinin__InfluenzaB__AGX24128
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugcauccacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180251 - RNA, 1755 nt, Artificial Sequence; identical to SEQ ID NO: 178946
  derived and/or modified sequence opt4 from hemagglutinin__InfluenzaB__AGX24139

SEQ ID NO: 180252 - RNA, 1755 nt, Artificial Sequence
  derived and/or modified sequence opt4 from hemagglutinin__InfluenzaB__AGX24150
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccuacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180253 - RNA, 1755 nt, Artificial Sequence; identical to SEQ ID NO: 179567
  derived and/or modified sequence opt4 from hemagglutinin__InfluenzaB__AGX24161

SEQ ID NO: 180254 - RNA, 1755 nt, Artificial Sequence; identical to SEQ ID NO: 179340
  derived and/or modified sequence opt4 from hemagglutinin__InfluenzaB__AGX24172

SEQ ID NO: 180255 - RNA, 1755 nt, Artificial Sequence; identical to SEQ ID NO: 179340
  derived and/or modified sequence opt4 from hemagglutinin__InfluenzaB__AGX24183

SEQ ID NO: 180256 - RNA, 1755 nt, Artificial Sequence; identical to SEQ ID NO: 179340
  derived and/or modified sequence opt4 from hemagglutinin__InfluenzaB__AGX24194

SEQ ID NO: 180257 - RNA, 1755 nt, Artificial Sequence; identical to SEQ ID NO: 179087
  derived and/or modified sequence opt4 from hemagglutinin__InfluenzaB__AGX24205

SEQ ID NO: 180258 - RNA, 1755 nt, Artificial Sequence; identical to SEQ ID NO: 179251
  derived and/or modified sequence opt4 from hemagglutinin__InfluenzaB__AGX24227

SEQ ID NO: 180259 - RNA, 1755 nt, Artificial Sequence; identical to SEQ ID NO: 179340
  derived and/or modified sequence opt4 from hemagglutinin__InfluenzaB__AGX24238

SEQ ID NO: 180260 - RNA, 1755 nt, Artificial Sequence
  derived and/or modified sequence opt4 from hemagglutinin__InfluenzaB__AGX24249
augaaggccaucaucgugcugcugaugguggugaccagcaacgccgacagaaucugcaccggcaucaccagcagcaagagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180261 - RNA, 1755 nt, Artificial Sequence; identical to SEQ ID NO: 179087
  derived and/or modified sequence opt4 from hemagglutinin__InfluenzaB__AGX24260

SEQ ID NO: 180262 - RNA, 1755 nt, Artificial Sequence; identical to SEQ ID NO: 179576
  derived and/or modified sequence opt4 from hemagglutinin__InfluenzaB__AGX24271

SEQ ID NO: 180263 - RNA, 1755 nt, Artificial Sequence
  derived and/or modified sequence opt4 from hemagglutinin__InfluenzaB__AGX24282
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccaagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180264 - RNA, 1755 nt, Artificial Sequence; identical to SEQ ID NO: 179087
  derived and/or modified sequence opt4 from hemagglutinin__InfluenzaB__AGX24293

SEQ ID NO: 180265 - RNA, 1755 nt, Artificial Sequence; identical to SEQ ID NO: 179087
  derived and/or modified sequence opt4 from hemagglutinin__InfluenzaB__AGX24304

SEQ ID NO: 180266 - RNA, 1755 nt, Artificial Sequence; identical to SEQ ID NO: 179576
  derived and/or modified sequence opt4 from hemagglutinin__InfluenzaB__AGX24315

SEQ ID NO: 180267 - RNA, 1755 nt, Artificial Sequence
  derived and/or modified sequence opt4 from hemagglutinin__InfluenzaB__AGX24326
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaccugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180268 - RNA, 1755 nt, Artificial Sequence
  derived and/or modified sequence opt4 from hemagglutinin__InfluenzaB__AGX24337
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcaugcccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180269 - RNA, 1755 nt, Artificial Sequence; identical to SEQ ID NO: 179340
  derived and/or modified sequence opt4 from hemagglutinin__InfluenzaB__AGX24348

SEQ ID NO: 180270 - RNA, 1755 nt, Artificial Sequence; identical to SEQ ID NO: 179087
  derived and/or modified sequence opt4 from hemagglutinin__InfluenzaB__AGX24359

SEQ ID NO: 180271 - RNA, 1755 nt, Artificial Sequence; identical to SEQ ID NO: 179340
  derived and/or modified sequence opt4 from hemagglutinin__InfluenzaB__AGX24381

SEQ ID NO: 180272 - RNA, 1755 nt, Artificial Sequence
  derived and/or modified sequence opt4 from hemagglutinin__InfluenzaB__AGX24392
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggagauccccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180273 - RNA, 1755 nt, Artificial Sequence; identical to SEQ ID NO: 179087
  derived and/or modified sequence opt4 from hemagglutinin__InfluenzaB__AGX24403

SEQ ID NO: 180274 - RNA, 1755 nt, Artificial Sequence; identical to SEQ ID NO: 179340
  derived and/or modified sequence opt4 from hemagglutinin__InfluenzaB__AGX24414

SEQ ID NO: 180275 - RNA, 1755 nt, Artificial Sequence; identical to SEQ ID NO: 179087
  derived and/or modified sequence opt4 from hemagglutinin__InfluenzaB__AGX24425

SEQ ID NO: 180276 - RNA, 1755 nt, Artificial Sequence; identical to SEQ ID NO: 179087
  derived and/or modified sequence opt4 from hemagglutinin__InfluenzaB__AGX24436

SEQ ID NO: 180277 - RNA, 1755 nt, Artificial Sequence; identical to SEQ ID NO: 179576
  derived and/or modified sequence opt4 from hemagglutinin__InfluenzaB__AGX24447

SEQ ID NO: 180278 - RNA, 1755 nt, Artificial Sequence; identical to SEQ ID NO: 180267
  derived and/or modified sequence opt4 from hemagglutinin__InfluenzaB__AGX24458

SEQ ID NO: 180279 - RNA, 1755 nt, Artificial Sequence
  derived and/or modified sequence opt4 from hemagglutinin__InfluenzaB__AGX24469
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaccugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugguggccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180280 - RNA, 1755 nt, Artificial Sequence; identical to SEQ ID NO: 179576
  derived and/or modified sequence opt4 from hemagglutinin__InfluenzaB__AGX24480

SEQ ID NO: 180281 - RNA, 1755 nt, Artificial Sequence; identical to SEQ ID NO: 179576
  derived and/or modified sequence opt4 from hemagglutinin__InfluenzaB__AGX24491

SEQ ID NO: 180282 - RNA, 1755 nt, Artificial Sequence
  derived and/or modified sequence opt4 from hemagglutinin__InfluenzaB__AGX24502
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcagaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180283 - RNA, 1755 nt, Artificial Sequence; identical to SEQ ID NO: 179251
  derived and/or modified sequence opt4 from hemagglutinin__InfluenzaB__AGX24513

SEQ ID NO: 180284 - RNA, 1755 nt, Artificial Sequence; identical to SEQ ID NO: 179576
  derived and/or modified sequence opt4 from hemagglutinin__InfluenzaB__AGX24524

SEQ ID NO: 180285 - RNA, 1755 nt, Artificial Sequence
  derived and/or modified sequence opt4 from hemagglutinin__InfluenzaB__AGX24535
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcgcccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180286 - RNA, 1755 nt, Artificial Sequence; identical to SEQ ID NO: 179087
  derived and/or modified sequence opt4 from hemagglutinin__InfluenzaB__AGX24546

SEQ ID NO: 180287 - RNA, 1755 nt, Artificial Sequence
  derived and/or modified sequence opt4 from hemagglutinin__InfluenzaB__AGX24557
augaagaccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaccugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180288 - RNA, 1755 nt, Artificial Sequence; identical to SEQ ID NO: 179576
  derived and/or modified sequence opt4 from hemagglutinin__InfluenzaB__AGX24579

SEQ ID NO: 180289 - RNA, 1755 nt, Artificial Sequence; identical to SEQ ID NO: 179576
  derived and/or modified sequence opt4 from hemagglutinin__InfluenzaB__AGX24590

SEQ ID NO: 180290 - RNA, 1755 nt, Artificial Sequence; identical to SEQ ID NO: 179576
  derived and/or modified sequence opt4 from hemagglutinin__InfluenzaB__AGX24601

SEQ ID NO: 180291 - RNA, 1755 nt, Artificial Sequence; identical to SEQ ID NO: 179576
  derived and/or modified sequence opt4 from hemagglutinin__InfluenzaB__AGX24612

SEQ ID NO: 180292 - RNA, 1755 nt, Artificial Sequence; identical to SEQ ID NO: 179087
  derived and/or modified sequence opt4 from hemagglutinin__InfluenzaB__AGX24623

SEQ ID NO: 180293 - RNA, 1755 nt, Artificial Sequence; identical to SEQ ID NO: 179576
  derived and/or modified sequence opt4 from hemagglutinin__InfluenzaB__AGX24634

SEQ ID NO: 180294 - RNA, 1755 nt, Artificial Sequence; identical to SEQ ID NO: 180285
  derived and/or modified sequence opt4 from hemagglutinin__InfluenzaB__AGX24656

SEQ ID NO: 180295 - RNA, 1755 nt, Artificial Sequence; identical to SEQ ID NO: 179087
  derived and/or modified sequence opt4 from hemagglutinin__InfluenzaB__AGX24667

SEQ ID NO: 180296 - RNA, 1755 nt, Artificial Sequence; identical to SEQ ID NO: 179340
  derived and/or modified sequence opt4 from hemagglutinin__InfluenzaB__AGX24678

SEQ ID NO: 180297 - RNA, 1755 nt, Artificial Sequence; identical to SEQ ID NO: 179576
  derived and/or modified sequence opt4 from hemagglutinin__InfluenzaB__AGX24689

SEQ ID NO: 180298 - RNA, 1755 nt, Artificial Sequence; identical to SEQ ID NO: 179576
  derived and/or modified sequence opt4 from hemagglutinin__InfluenzaB__AGX24700

SEQ ID NO: 180299 - RNA, 1755 nt, Artificial Sequence; identical to SEQ ID NO: 179576
  derived and/or modified sequence opt4 from hemagglutinin__InfluenzaB__AGX24711

SEQ ID NO: 180300 - RNA, 1755 nt, Artificial Sequence; identical to SEQ ID NO: 179087
  derived and/or modified sequence opt4 from hemagglutinin__InfluenzaB__AGX24722

SEQ ID NO: 180301 - RNA, 1755 nt, Artificial Sequence; identical to SEQ ID NO: 179087
  derived and/or modified sequence opt4 from hemagglutinin__InfluenzaB__AGX24733

SEQ ID NO: 180302 - RNA, 1755 nt, Artificial Sequence; identical to SEQ ID NO: 179087
  derived and/or modified sequence opt4 from hemagglutinin__InfluenzaB__AGX24744

SEQ ID NO: 180303 - RNA, 1755 nt, Artificial Sequence; identical to SEQ ID NO: 179087
  derived and/or modified sequence opt4 from hemagglutinin__InfluenzaB__AGX24755

SEQ ID NO: 180304 - RNA, 1755 nt, Artificial Sequence; identical to SEQ ID NO: 179576
  derived and/or modified sequence opt4 from hemagglutinin__InfluenzaB__AGX24766

SEQ ID NO: 180305 - RNA, 1755 nt, Artificial Sequence; identical to SEQ ID NO: 179087
  derived and/or modified sequence opt4 from hemagglutinin__InfluenzaB__AGX24777

SEQ ID NO: 180306 - RNA, 1755 nt, Artificial Sequence; identical to SEQ ID NO: 179087
  derived and/or modified sequence opt4 from hemagglutinin__InfluenzaB__AGX24788

SEQ ID NO: 180307 - RNA, 1755 nt, Artificial Sequence; identical to SEQ ID NO: 179087
  derived and/or modified sequence opt4 from hemagglutinin__InfluenzaB__AGX24799

SEQ ID NO: 180308 - RNA, 1755 nt, Artificial Sequence; identical to SEQ ID NO: 179576
  derived and/or modified sequence opt4 from hemagglutinin__InfluenzaB__AGX24810

SEQ ID NO: 180309 - RNA, 1755 nt, Artificial Sequence; identical to SEQ ID NO: 179576
  derived and/or modified sequence opt4 from hemagglutinin__InfluenzaB__AGX24821

SEQ ID NO: 180310 - RNA, 1755 nt, Artificial Sequence
  derived and/or modified sequence opt4 from hemagglutinin__InfluenzaB__AGX24832
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcauccugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180311 - RNA, 1755 nt, Artificial Sequence
  derived and/or modified sequence opt4 from hemagglutinin__InfluenzaB__AGX24843
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagagaguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180312 - RNA, 1755 nt, Artificial Sequence
  derived and/or modified sequence opt4 from hemagglutinin__InfluenzaB__AGX24854
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgagugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagagacccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180313 - RNA, 1755 nt, Artificial Sequence
  derived and/or modified sequence opt4 from hemagglutinin__InfluenzaB__AGX24865
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagagacccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180314 - RNA, 1755 nt, Artificial Sequence
  derived and/or modified sequence opt4 from hemagglutinin__InfluenzaB__AGX24876
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacagccugaccguggaggugcccuacaucugcaaggagggcgaggaccagaucaccguguggggcuuccacagcgacaacaagccccagaugaagaaccuguacggcgacagcaacccccagaaguucaccagcagcgccaacggcgugaccacccacuacgugagccaggugggcgacuuccccgaccagaccgaggacggcggccugccccagagcggcagaaucgugguggacuacaugaugcagaagcccggcagaaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180315 - RNA, 1755 nt, Artificial Sequence
  derived and/or modified sequence opt4 from hemagglutinin__InfluenzaB__AGX24887
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaugagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180316 - RNA, 1755 nt, Artificial Sequence
  derived and/or modified sequence opt4 from hemagglutinin__InfluenzaB__AGX24898
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccggcggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180317 - RNA, 1758 nt, Artificial Sequence; identical to SEQ ID NO: 179203
  derived and/or modified sequence opt4 from hemagglutinin__InfluenzaB__AGX84854

SEQ ID NO: 180318 - RNA, 1758 nt, Artificial Sequence
  derived and/or modified sequence opt4 from hemagglutinin__InfluenzaB__AGX84865
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180319 - RNA, 1758 nt, Artificial Sequence; identical to SEQ ID NO: 180318
  derived and/or modified sequence opt4 from hemagglutinin__InfluenzaB__AGX84876

SEQ ID NO: 180320 - RNA, 1758 nt, Artificial Sequence; identical to SEQ ID NO: 180318
  derived and/or modified sequence opt4 from hemagglutinin__InfluenzaB__AGX84887

SEQ ID NO: 180321 - RNA, 1758 nt, Artificial Sequence; identical to SEQ ID NO: 179203
  derived and/or modified sequence opt4 from hemagglutinin__InfluenzaB__AGX84898

SEQ ID NO: 180322 - RNA, 1758 nt, Artificial Sequence
  derived and/or modified sequence opt4 from hemagglutinin__InfluenzaB__AGX84920
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccggcgugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180323 - RNA, 1758 nt, Artificial Sequence
  derived and/or modified sequence opt4 from hemagglutinin__InfluenzaB__AGZ59821
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugcuucaacugcaccgaccuggacguggcccugggcagacccaagugcaccggcaacauccccagcgccaaggugagcauccugcacgaggugagacccgugaccagcggcugcuuccccaucaugcacgacagaaccaaggugagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180324 - RNA, 1758 nt, Artificial Sequence
  derived and/or modified sequence opt4 from hemagglutinin__InfluenzaB__AGZ59832
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcaagagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgaggacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180325 - RNA, 1758 nt, Artificial Sequence
  derived and/or modified sequence opt4 from hemagglutinin__InfluenzaB__AGZ59843
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180326 - RNA, 1758 nt, Artificial Sequence; identical to SEQ ID NO: 179672
  derived and/or modified sequence opt4 from hemagglutinin__InfluenzaB__AGZ59854

SEQ ID NO: 180327 - RNA, 1758 nt, Artificial Sequence; identical to SEQ ID NO: 179034
  derived and/or modified sequence opt4 from hemagglutinin__InfluenzaB__AGZ59865

SEQ ID NO: 180328 - RNA, 1758 nt, Artificial Sequence
  derived and/or modified sequence opt4 from hemagglutinin__InfluenzaB__AGZ59876
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180329 - RNA, 1755 nt, Artificial Sequence; identical to SEQ ID NO: 179087
  derived and/or modified sequence opt4 from hemagglutinin__InfluenzaB__AGZ59887

SEQ ID NO: 180330 - RNA, 1758 nt, Artificial Sequence; identical to SEQ ID NO: 179509
  derived and/or modified sequence opt4 from hemagglutinin__InfluenzaB__AGZ59898

SEQ ID NO: 180331 - RNA, 1758 nt, Artificial Sequence; identical to SEQ ID NO: 179875
  derived and/or modified sequence opt4 from hemagglutinin__InfluenzaB__AGZ59909

SEQ ID NO: 180332 - RNA, 1758 nt, Artificial Sequence; identical to SEQ ID NO: 179509
  derived and/or modified sequence opt4 from hemagglutinin__InfluenzaB__AGZ59920

SEQ ID NO: 180333 - RNA, 1758 nt, Artificial Sequence; identical to SEQ ID NO: 179509
  derived and/or modified sequence opt4 from hemagglutinin__InfluenzaB__AGZ59931

SEQ ID NO: 180334 - RNA, 1758 nt, Artificial Sequence; identical to SEQ ID NO: 179509
  derived and/or modified sequence opt4 from hemagglutinin__InfluenzaB__AGZ59942

SEQ ID NO: 180335 - RNA, 1758 nt, Artificial Sequence; identical to SEQ ID NO: 179509
  derived and/or modified sequence opt4 from hemagglutinin__InfluenzaB__AGZ59953

SEQ ID NO: 180336 - RNA, 1758 nt, Artificial Sequence
  derived and/or modified sequence opt4 from hemagglutinin__InfluenzaB__AGZ59965
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaguggugguggacuacaugaugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180337 - RNA, 1758 nt, Artificial Sequence; identical to SEQ ID NO: 179509
  derived and/or modified sequence opt4 from hemagglutinin__InfluenzaB__AGZ59976

SEQ ID NO: 180338 - RNA, 1758 nt, Artificial Sequence; identical to SEQ ID NO: 179509
  derived and/or modified sequence opt4 from hemagglutinin__InfluenzaB__AGZ59987

SEQ ID NO: 180339 - RNA, 1758 nt, Artificial Sequence; identical to SEQ ID NO: 179509
  derived and/or modified sequence opt4 from hemagglutinin__InfluenzaB__AGZ59999

SEQ ID NO: 180340 - RNA, 1758 nt, Artificial Sequence; identical to SEQ ID NO: 179128
  derived and/or modified sequence opt4 from hemagglutinin__InfluenzaB__AGZ60010

SEQ ID NO: 180341 - RNA, 1758 nt, Artificial Sequence; identical to SEQ ID NO: 179128
  derived and/or modified sequence opt4 from hemagglutinin__InfluenzaB__AGZ60021

SEQ ID NO: 180342 - RNA, 1758 nt, Artificial Sequence; identical to SEQ ID NO: 179128
  derived and/or modified sequence opt4 from hemagglutinin__InfluenzaB__AGZ60033

SEQ ID NO: 180343 - RNA, 1755 nt, Artificial Sequence
  derived and/or modified sequence opt4 from hemagglutinin__InfluenzaB__AGZ60044
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180344 - RNA, 1755 nt, Artificial Sequence; identical to SEQ ID NO: 179546
  derived and/or modified sequence opt4 from hemagglutinin__InfluenzaB__AGZ60055

SEQ ID NO: 180345 - RNA, 1755 nt, Artificial Sequence
  derived and/or modified sequence opt4 from hemagglutinin__InfluenzaB__AGZ60066
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccugggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180346 - RNA, 1755 nt, Artificial Sequence
  derived and/or modified sequence opt4 from hemagglutinin__InfluenzaB__AGZ60077
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagccccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagagcggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacagcgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180347 - RNA, 1755 nt, Artificial Sequence; identical to SEQ ID NO: 179251
  derived and/or modified sequence opt4 from hemagglutinin__InfluenzaB__AGZ60088

SEQ ID NO: 180348 - RNA, 1755 nt, Artificial Sequence; identical to SEQ ID NO: 178946
  derived and/or modified sequence opt4 from hemagglutinin__InfluenzaB__AGZ60099

SEQ ID NO: 180349 - RNA, 1755 nt, Artificial Sequence
  derived and/or modified sequence opt4 from hemagglutinin__InfluenzaB__AGZ60131
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccaucaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180350 - RNA, 1755 nt, Artificial Sequence; identical to SEQ ID NO: 179251
  derived and/or modified sequence opt4 from hemagglutinin__InfluenzaB__AGZ60142

SEQ ID NO: 180351 - RNA, 1755 nt, Artificial Sequence; identical to SEQ ID NO: 179251
  derived and/or modified sequence opt4 from hemagglutinin__InfluenzaB__AGZ60160

SEQ ID NO: 180352 - RNA, 1755 nt, Artificial Sequence; identical to SEQ ID NO: 179340
  derived and/or modified sequence opt4 from hemagglutinin__InfluenzaB__AGZ60172

SEQ ID NO: 180353 - RNA, 1755 nt, Artificial Sequence; identical to SEQ ID NO: 179340
  derived and/or modified sequence opt4 from hemagglutinin__InfluenzaB__AGZ60183

SEQ ID NO: 180354 - RNA, 1755 nt, Artificial Sequence
  derived and/or modified sequence opt4 from hemagglutinin__InfluenzaB__AGZ60194
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagaccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180355 - RNA, 1755 nt, Artificial Sequence
  derived and/or modified sequence opt4 from hemagglutinin__InfluenzaB__AGZ60206
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaucaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180356 - RNA, 1755 nt, Artificial Sequence; identical to SEQ ID NO: 180285
  derived and/or modified sequence opt4 from hemagglutinin__InfluenzaB__AGZ60217

SEQ ID NO: 180357 - RNA, 1755 nt, Artificial Sequence
  derived and/or modified sequence opt4 from hemagglutinin__InfluenzaB__AGZ60268
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180358 - RNA, 1755 nt, Artificial Sequence; identical to SEQ ID NO: 179374
  derived and/or modified sequence opt4 from hemagglutinin__InfluenzaB__AHE37993

SEQ ID NO: 180359 - RNA, 1755 nt, Artificial Sequence; identical to SEQ ID NO: 179419
  derived and/or modified sequence opt4 from hemagglutinin__InfluenzaB__AHE37994

SEQ ID NO: 180360 - RNA, 1755 nt, Artificial Sequence; identical to SEQ ID NO: 179374
  derived and/or modified sequence opt4 from hemagglutinin__InfluenzaB__AHE37995

SEQ ID NO: 180361 - RNA, 1755 nt, Artificial Sequence; identical to SEQ ID NO: 179374
  derived and/or modified sequence opt4 from hemagglutinin__InfluenzaB__AHE37996

SEQ ID NO: 180362 - RNA, 1755 nt, Artificial Sequence; identical to SEQ ID NO: 179419
  derived and/or modified sequence opt4 from hemagglutinin__InfluenzaB__AHE37997

SEQ ID NO: 180363 - RNA, 1755 nt, Artificial Sequence; identical to SEQ ID NO: 179419
  derived and/or modified sequence opt4 from hemagglutinin__InfluenzaB__AHE37998

SEQ ID NO: 180364 - RNA, 1755 nt, Artificial Sequence; identical to SEQ ID NO: 179419
  derived and/or modified sequence opt4 from hemagglutinin__InfluenzaB__AHE37999

SEQ ID NO: 180365 - RNA, 1755 nt, Artificial Sequence; identical to SEQ ID NO: 179374
  derived and/or modified sequence opt4 from hemagglutinin__InfluenzaB__AHE38000

SEQ ID NO: 180366 - RNA, 1755 nt, Artificial Sequence; identical to SEQ ID NO: 179374
  derived and/or modified sequence opt4 from hemagglutinin__InfluenzaB__AHE38001

SEQ ID NO: 180367 - RNA, 1755 nt, Artificial Sequence
  derived and/or modified sequence opt4 from hemagglutinin__InfluenzaB__AHE38002
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccaagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180368 - RNA, 1755 nt, Artificial Sequence; identical to SEQ ID NO: 179374
  derived and/or modified sequence opt4 from hemagglutinin__InfluenzaB__AHE38003

SEQ ID NO: 180369 - RNA, 1755 nt, Artificial Sequence; identical to SEQ ID NO: 179374
  derived and/or modified sequence opt4 from hemagglutinin__InfluenzaB__AHE38004

SEQ ID NO: 180370 - RNA, 1755 nt, Artificial Sequence; identical to SEQ ID NO: 179374
  derived and/or modified sequence opt4 from hemagglutinin__InfluenzaB__AHE38005

SEQ ID NO: 180371 - RNA, 1755 nt, Artificial Sequence
  derived and/or modified sequence opt4 from hemagglutinin__InfluenzaB__AHE38006
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcgccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccguggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180372 - RNA, 1755 nt, Artificial Sequence; identical to SEQ ID NO: 179374
  derived and/or modified sequence opt4 from hemagglutinin__InfluenzaB__AHE38007

SEQ ID NO: 180373 - RNA, 1755 nt, Artificial Sequence
  derived and/or modified sequence opt4 from hemagglutinin__InfluenzaB__AHE38008
augaaggccaucaucgcccugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180374 - RNA, 1755 nt, Artificial Sequence; identical to SEQ ID NO: 179419
  derived and/or modified sequence opt4 from hemagglutinin__InfluenzaB__AHE38009

SEQ ID NO: 180375 - RNA, 1755 nt, Artificial Sequence; identical to SEQ ID NO: 179419
  derived and/or modified sequence opt4 from hemagglutinin__InfluenzaB__AHE38010

SEQ ID NO: 180376 - RNA, 1755 nt, Artificial Sequence; identical to SEQ ID NO: 179374
  derived and/or modified sequence opt4 from hemagglutinin__InfluenzaB__AHE38012

SEQ ID NO: 180377 - RNA, 1755 nt, Artificial Sequence
  derived and/or modified sequence opt4 from hemagglutinin__InfluenzaB__AHE38013
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgugagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcauggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180378 - RNA, 1755 nt, Artificial Sequence; identical to SEQ ID NO: 179374
  derived and/or modified sequence opt4 from hemagglutinin__InfluenzaB__AHE38014

SEQ ID NO: 180379 - RNA, 1758 nt, Artificial Sequence; identical to SEQ ID NO: 179165
  derived and/or modified sequence opt4 from hemagglutinin__InfluenzaB__AHE38015

SEQ ID NO: 180380 - RNA, 1758 nt, Artificial Sequence
  derived and/or modified sequence opt4 from hemagglutinin__InfluenzaB__AHE38016
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcaagagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaucauccugcuguacuacagcaccgccgccagcagccuggccgugacccugaugaucgccaucuucgugguguacauggugagcagagacaacgugagcugcagcaucugccuguga

SEQ ID NO: 180381 - RNA, 1758 nt, Artificial Sequence; identical to SEQ ID NO: 179484
  derived and/or modified sequence opt4 from hemagglutinin__InfluenzaB__AHE38017

SEQ ID NO: 180382 - RNA, 1758 nt, Artificial Sequence; identical to SEQ ID NO: 179407
  derived and/or modified sequence opt4 from hemagglutinin__InfluenzaB__AHE38018

SEQ ID NO: 180383 - RNA, 1758 nt, Artificial Sequence; identical to SEQ ID NO: 179392
  derived and/or modified sequence opt4 from hemagglutinin__InfluenzaB__AHE38019

SEQ ID NO: 180384 - RNA, 1758 nt, Artificial Sequence
  derived and/or modified sequence opt4 from hemagglutinin__InfluenzaB__AHE38020
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaucacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180385 - RNA, 1758 nt, Artificial Sequence
  derived and/or modified sequence opt4 from hemagglutinin__InfluenzaB__AHE38021
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180386 - RNA, 1758 nt, Artificial Sequence; identical to SEQ ID NO: 179407
  derived and/or modified sequence opt4 from hemagglutinin__InfluenzaB__AHE38022

SEQ ID NO: 180387 - RNA, 1752 nt, Artificial Sequence
  derived and/or modified sequence opt4 from hemagglutinin__InfluenzaB__AHL91189
augaaggccaucaucgugcugcugaugguggccaccagcaacgccgacagaaucugcaccggcaucaccagcagcaacagcccccacguggugaagaccgccacccagggcgaggugaacgugaccggcgugaucagccugaccaccacccccaccaagagccacuucgccaaccugaagggcaccaagaccagaggcaagcugugccccaacugccugaacugcaccgaccuggacguggcccugggcagacccaucugcaucggcaccauccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180388 - RNA, 1752 nt, Artificial Sequence
  derived and/or modified sequence opt4 from hemagglutinin__InfluenzaB__AHL91200
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaccauccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180389 - RNA, 1752 nt, Artificial Sequence
  derived and/or modified sequence opt4 from hemagglutinin__InfluenzaB__AHL91211
augaaggccaucaucgugcugcugaugguggccaccagcaacgccgacagaaucugcaccggcaucaccagcagcaacagcccccacguggugaagaccgccacccagggcgaggugaacgugaccggcgugaucagccugaccaccacccccaccaagagccacuucgccaaccugaagggcaccaagaccagaggcaagcugugccccaacugccugaacugcaccgaccuggacguggcccugggcagacccaugugcaucggcaccauccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180390 - RNA, 1755 nt, Artificial Sequence
  derived and/or modified sequence opt4 from hemagglutinin__InfluenzaB__AHL91222
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacaucagcugcagcaucugccuguga

SEQ ID NO: 180391 - RNA, 1755 nt, Artificial Sequence
  derived and/or modified sequence opt4 from hemagglutinin__InfluenzaB__AHL91244
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180392 - RNA, 1755 nt, Artificial Sequence; identical to SEQ ID NO: 179021
  derived and/or modified sequence opt4 from hemagglutinin__InfluenzaB__AHL91255

SEQ ID NO: 180393 - RNA, 1755 nt, Artificial Sequence; identical to SEQ ID NO: 179021
  derived and/or modified sequence opt4 from hemagglutinin__InfluenzaB__AHL91266

SEQ ID NO: 180394 - RNA, 1752 nt, Artificial Sequence
  derived and/or modified sequence opt4 from hemagglutinin__InfluenzaB__AHL91277
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaucacccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180395 - RNA, 1755 nt, Artificial Sequence
  derived and/or modified sequence opt4 from hemagglutinin__InfluenzaB__AHL91299
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccagaagccacuucgccaaccugaagggcaccaagaccagaggcaagcugugccccaccugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180396 - RNA, 1755 nt, Artificial Sequence
  derived and/or modified sequence opt4 from hemagglutinin__InfluenzaB__AHL91310
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180397 - RNA, 1755 nt, Artificial Sequence
  derived and/or modified sequence opt4 from hemagglutinin__InfluenzaB__AHL91321
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagaagggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180398 - RNA, 1755 nt, Artificial Sequence; identical to SEQ ID NO: 180396
  derived and/or modified sequence opt4 from hemagglutinin__InfluenzaB__AHL91332

SEQ ID NO: 180399 - RNA, 1755 nt, Artificial Sequence; identical to SEQ ID NO: 180396
  derived and/or modified sequence opt4 from hemagglutinin__InfluenzaB__AHL91343

SEQ ID NO: 180400 - RNA, 1755 nt, Artificial Sequence; identical to SEQ ID NO: 180396
  derived and/or modified sequence opt4 from hemagglutinin__InfluenzaB__AHL91354

SEQ ID NO: 180401 - RNA, 1755 nt, Artificial Sequence; identical to SEQ ID NO: 178999
  derived and/or modified sequence opt4 from hemagglutinin__InfluenzaB__AHL91365

SEQ ID NO: 180402 - RNA, 1755 nt, Artificial Sequence
  derived and/or modified sequence opt4 from hemagglutinin__InfluenzaB__AHL91376
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccgccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180403 - RNA, 1755 nt, Artificial Sequence
  derived and/or modified sequence opt4 from hemagglutinin__InfluenzaB__AHL91387
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccgccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180404 - RNA, 1755 nt, Artificial Sequence
  derived and/or modified sequence opt4 from hemagglutinin__InfluenzaB__AHL91409
augaaggccaucaucgugcugcugaugguggugaccagcaacgccgacagaaucugcaccggcaucaccagcagcgacagcccccacguggugaagaccgccacccagggcgaggugaacgugaccggcgccaucccccugaccaccacccccaccaagagcuacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugguggccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180405 - RNA, 1755 nt, Artificial Sequence
  derived and/or modified sequence opt4 from hemagglutinin__InfluenzaB__AHL91431
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacuuccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180406 - RNA, 1755 nt, Artificial Sequence
  derived and/or modified sequence opt4 from hemagglutinin__InfluenzaB__AHL91442
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaccgcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180407 - RNA, 1755 nt, Artificial Sequence
  derived and/or modified sequence opt4 from hemagglutinin__InfluenzaB__AHL91453
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccaucgaggugccccacgugugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180408 - RNA, 1755 nt, Artificial Sequence; identical to SEQ ID NO: 178925
  derived and/or modified sequence opt4 from hemagglutinin__InfluenzaB__AHL91464

SEQ ID NO: 180409 - RNA, 1755 nt, Artificial Sequence; identical to SEQ ID NO: 179031
  derived and/or modified sequence opt4 from hemagglutinin__InfluenzaB__AHL91475

SEQ ID NO: 180410 - RNA, 1755 nt, Artificial Sequence; identical to SEQ ID NO: 180406
  derived and/or modified sequence opt4 from hemagglutinin__InfluenzaB__AHL91486

SEQ ID NO: 180411 - RNA, 1755 nt, Artificial Sequence; identical to SEQ ID NO: 180406
  derived and/or modified sequence opt4 from hemagglutinin__InfluenzaB__AHL91497

SEQ ID NO: 180412 - RNA, 1755 nt, Artificial Sequence; identical to SEQ ID NO: 180406
  derived and/or modified sequence opt4 from hemagglutinin__InfluenzaB__AHL91530

SEQ ID NO: 180413 - RNA, 1755 nt, Artificial Sequence; identical to SEQ ID NO: 178925
  derived and/or modified sequence opt4 from hemagglutinin__InfluenzaB__AHL91541

SEQ ID NO: 180414 - RNA, 1755 nt, Artificial Sequence; identical to SEQ ID NO: 180406
  derived and/or modified sequence opt4 from hemagglutinin__InfluenzaB__AHL91552

SEQ ID NO: 180415 - RNA, 1755 nt, Artificial Sequence; identical to SEQ ID NO: 180406
  derived and/or modified sequence opt4 from hemagglutinin__InfluenzaB__AHL91574

SEQ ID NO: 180416 - RNA, 1755 nt, Artificial Sequence
  derived and/or modified sequence opt4 from hemagglutinin__InfluenzaB__AHL91585
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180417 - RNA, 1755 nt, Artificial Sequence
  derived and/or modified sequence opt4 from hemagglutinin__InfluenzaB__AHL91596
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagauccugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180418 - RNA, 1755 nt, Artificial Sequence; identical to SEQ ID NO: 180417
  derived and/or modified sequence opt4 from hemagglutinin__InfluenzaB__AHL91607

SEQ ID NO: 180419 - RNA, 1755 nt, Artificial Sequence
  derived and/or modified sequence opt4 from hemagglutinin__InfluenzaB__AHL91618
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaccgcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgugggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180420 - RNA, 1755 nt, Artificial Sequence
  derived and/or modified sequence opt4 from hemagglutinin__InfluenzaB__AHL91629
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugcuucaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacaagcugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180421 - RNA, 1755 nt, Artificial Sequence; identical to SEQ ID NO: 180420
  derived and/or modified sequence opt4 from hemagglutinin__InfluenzaB__AHL91640

SEQ ID NO: 180422 - RNA, 1755 nt, Artificial Sequence; identical to SEQ ID NO: 178927
  derived and/or modified sequence opt4 from hemagglutinin__InfluenzaB__AHL91651

SEQ ID NO: 180423 - RNA, 1752 nt, Artificial Sequence
  derived and/or modified sequence opt4 from hemagglutinin__InfluenzaB__AHL91662
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaccgcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180424 - RNA, 1755 nt, Artificial Sequence; identical to SEQ ID NO: 179031
  derived and/or modified sequence opt4 from hemagglutinin__InfluenzaB__AHL91673

SEQ ID NO: 180425 - RNA, 1755 nt, Artificial Sequence
  derived and/or modified sequence opt4 from hemagglutinin__InfluenzaB__AHL91684
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccaucgaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcuuccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 180426 - RNA, 1755 nt, Artificial Sequence; identical to SEQ ID NO: 178927
  derived and/or modified sequence opt4 from hemagglutinin__InfluenzaB__AHL91695

SEQ ID NO: 180427 - RNA, 1755 nt, Artificial Sequence; identical to SEQ ID NO: 179031
  derived and/or modified sequence opt4 from hemagglutinin__InfluenzaB__AHL91706

SEQ ID NO: 180428 - RNA, 1758 nt, Artificial Sequence; identical to SEQ ID NO: 179499
  derived and/or modified sequence opt4 from hemagglutinin__InfluenzaB__AHL91717

SEQ ID NO: 180429 - RNA, 1758 nt, Artificial Sequence; identical to SEQ ID NO: 179499
  derived and/or modified sequence opt4 from hemagglutinin__InfluenzaB__AHL91728

SEQ ID NO: 180430 - RNA, 1758 nt, Artificial Sequence; identical to SEQ ID NO: 179499
  derived and/or modified sequence opt4 from hemagglutinin__InfluenzaB__AHL91739

SEQ ID NO: 180431 - RNA, 1755 nt, Artificial Sequence; identical to SEQ ID NO: 179031
  derived and/or modified sequence opt4 from hemagglutinin__InfluenzaB__AHL91750

SEQ ID NO: 180432 - RNA, 1758 nt, Artificial Sequence; identical to SEQ ID NO: 179499
  derived and/or modified sequence opt4 from hemagglutinin__InfluenzaB__AHL91761

SEQ ID NO: 180433 - RNA, 1758 nt, Artificial Sequence
  derived and/or modified sequence opt4 from hemagglutinin__InfluenzaB__AHL91772
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacaucaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180434 - RNA, 1758 nt, Artificial Sequence; identical to SEQ ID NO: 180433
  derived and/or modified sequence opt4 from hemagglutinin__InfluenzaB__AHL91783

SEQ ID NO: 180435 - RNA, 1758 nt, Artificial Sequence; identical to SEQ ID NO: 180433
  derived and/or modified sequence opt4 from hemagglutinin__InfluenzaB__AHL91794

SEQ ID NO: 180436 - RNA, 1758 nt, Artificial Sequence
  derived and/or modified sequence opt4 from hemagglutinin__InfluenzaB__AHL91805
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugcuucaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180437 - RNA, 1758 nt, Artificial Sequence; identical to SEQ ID NO: 178939
  derived and/or modified sequence opt4 from hemagglutinin__InfluenzaB__AHL91816

SEQ ID NO: 180438 - RNA, 1758 nt, Artificial Sequence; identical to SEQ ID NO: 178939
  derived and/or modified sequence opt4 from hemagglutinin__InfluenzaB__AHL91827

SEQ ID NO: 180439 - RNA, 1755 nt, Artificial Sequence; identical to SEQ ID NO: 179546
  derived and/or modified sequence opt4 from hemagglutinin__InfluenzaB__AHL91838

SEQ ID NO: 180440 - RNA, 1755 nt, Artificial Sequence
  derived and/or modified sequence opt4 from hemagglutinin__InfluenzaB__AHL91849
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggccagacccgugaccagcggcugcuuccccaucaugcacgacagaaccaagaucagacagcugcccaaccugcugagaggcuacgagaacaucagacugagcacccagaacgugaucgacgccgagaacgcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucagcggcuuccccgcccagaccgaggacggcggccugccccagagcggcagaaucgugguggacuacauggugcagaagcccagaaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180441 - RNA, 1755 nt, Artificial Sequence
  derived and/or modified sequence opt4 from hemagglutinin__InfluenzaB__AHL91860
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggagauccccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacgccauccugcuguacuacagcaccgccgccagcagccuggccgugacccugaugcuggccaucuucaucguguacauggugagcagagacaacgugagcugcagcaucugccuguga

SEQ ID NO: 180442 - RNA, 1755 nt, Artificial Sequence
  derived and/or modified sequence opt4 from hemagglutinin__InfluenzaB__AHL91871
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggagauccccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180443 - RNA, 1755 nt, Artificial Sequence; identical to SEQ ID NO: 178946
  derived and/or modified sequence opt4 from hemagglutinin__InfluenzaB__AHL91882

SEQ ID NO: 180444 - RNA, 1755 nt, Artificial Sequence
  derived and/or modified sequence opt4 from hemagglutinin__InfluenzaB__AHL91904
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcacggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180445 - RNA, 1755 nt, Artificial Sequence
  derived and/or modified sequence opt4 from hemagglutinin__InfluenzaB__AHL91915
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180446 - RNA, 1755 nt, Artificial Sequence; identical to SEQ ID NO: 179544
  derived and/or modified sequence opt4 from hemagglutinin__InfluenzaB__AHL91926

SEQ ID NO: 180447 - RNA, 1755 nt, Artificial Sequence; identical to SEQ ID NO: 180119
  derived and/or modified sequence opt4 from hemagglutinin__InfluenzaB__AHL91937

SEQ ID NO: 180448 - RNA, 1755 nt, Artificial Sequence; identical to SEQ ID NO: 178946
  derived and/or modified sequence opt4 from hemagglutinin__InfluenzaB__AHL91948

SEQ ID NO: 180449 - RNA, 1758 nt, Artificial Sequence
  derived and/or modified sequence opt4 from hemagglutinin__InfluenzaB__AHL91959
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagcuucaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180450 - RNA, 1758 nt, Artificial Sequence; identical to SEQ ID NO: 179158
  derived and/or modified sequence opt4 from hemagglutinin__InfluenzaB__AHL91970

SEQ ID NO: 180451 - RNA, 1755 nt, Artificial Sequence
  derived and/or modified sequence opt4 from hemagglutinin__InfluenzaB__AHL91991
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccaacaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180452 - RNA, 1758 nt, Artificial Sequence; identical to SEQ ID NO: 179034
  derived and/or modified sequence opt4 from hemagglutinin__InfluenzaB__AHL92002

SEQ ID NO: 180453 - RNA, 1758 nt, Artificial Sequence; identical to SEQ ID NO: 179034
  derived and/or modified sequence opt4 from hemagglutinin__InfluenzaB__AHL92013

SEQ ID NO: 180454 - RNA, 1758 nt, Artificial Sequence; identical to SEQ ID NO: 179034
  derived and/or modified sequence opt4 from hemagglutinin__InfluenzaB__AHL92024

SEQ ID NO: 180455 - RNA, 1758 nt, Artificial Sequence; identical to SEQ ID NO: 179034
  derived and/or modified sequence opt4 from hemagglutinin__InfluenzaB__AHL92035

SEQ ID NO: 180456 - RNA, 1758 nt, Artificial Sequence; identical to SEQ ID NO: 179034
  derived and/or modified sequence opt4 from hemagglutinin__InfluenzaB__AHL92046

SEQ ID NO: 180457 - RNA, 1758 nt, Artificial Sequence; identical to SEQ ID NO: 179034
  derived and/or modified sequence opt4 from hemagglutinin__InfluenzaB__AHL92057

SEQ ID NO: 180458 - RNA, 1758 nt, Artificial Sequence
  derived and/or modified sequence opt4 from hemagglutinin__InfluenzaB__AHL92068
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccaggugggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180459 - RNA, 1758 nt, Artificial Sequence
  derived and/or modified sequence opt4 from hemagglutinin__InfluenzaB__AHL92079
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180460 - RNA, 1758 nt, Artificial Sequence; identical to SEQ ID NO: 180459
  derived and/or modified sequence opt4 from hemagglutinin__InfluenzaB__AHL92090

SEQ ID NO: 180461 - RNA, 1758 nt, Artificial Sequence; identical to SEQ ID NO: 179034
  derived and/or modified sequence opt4 from hemagglutinin__InfluenzaB__AHL92101

SEQ ID NO: 180462 - RNA, 1755 nt, Artificial Sequence; identical to SEQ ID NO: 179087
  derived and/or modified sequence opt4 from hemagglutinin__InfluenzaB__AHL92112

SEQ ID NO: 180463 - RNA, 1758 nt, Artificial Sequence; identical to SEQ ID NO: 179034
  derived and/or modified sequence opt4 from hemagglutinin__InfluenzaB__AHL92123

SEQ ID NO: 180464 - RNA, 1758 nt, Artificial Sequence; identical to SEQ ID NO: 180459
  derived and/or modified sequence opt4 from hemagglutinin__InfluenzaB__AHL92134

SEQ ID NO: 180465 - RNA, 1758 nt, Artificial Sequence; identical to SEQ ID NO: 180459
  derived and/or modified sequence opt4 from hemagglutinin__InfluenzaB__AHL92145

SEQ ID NO: 180466 - RNA, 1758 nt, Artificial Sequence; identical to SEQ ID NO: 179034
  derived and/or modified sequence opt4 from hemagglutinin__InfluenzaB__AHL92156

SEQ ID NO: 180467 - RNA, 1758 nt, Artificial Sequence; identical to SEQ ID NO: 180459
  derived and/or modified sequence opt4 from hemagglutinin__InfluenzaB__AHL92167

SEQ ID NO: 180468 - RNA, 1758 nt, Artificial Sequence; identical to SEQ ID NO: 179034
  derived and/or modified sequence opt4 from hemagglutinin__InfluenzaB__AHL92178

SEQ ID NO: 180469 - RNA, 1758 nt, Artificial Sequence; identical to SEQ ID NO: 179034
  derived and/or modified sequence opt4 from hemagglutinin__InfluenzaB__AHL92189

SEQ ID NO: 180470 - RNA, 1755 nt, Artificial Sequence; identical to SEQ ID NO: 179087
  derived and/or modified sequence opt4 from hemagglutinin__InfluenzaB__AHL92200

SEQ ID NO: 180471 - RNA, 1758 nt, Artificial Sequence; identical to SEQ ID NO: 179034
  derived and/or modified sequence opt4 from hemagglutinin__InfluenzaB__AHL92211

SEQ ID NO: 180472 - RNA, 1758 nt, Artificial Sequence; identical to SEQ ID NO: 179034
  derived and/or modified sequence opt4 from hemagglutinin__InfluenzaB__AHL92222

SEQ ID NO: 180473 - RNA, 1755 nt, Artificial Sequence; identical to SEQ ID NO: 180349
  derived and/or modified sequence opt4 from hemagglutinin__InfluenzaB__AHL92233

SEQ ID NO: 180474 - RNA, 1758 nt, Artificial Sequence; identical to SEQ ID NO: 180459
  derived and/or modified sequence opt4 from hemagglutinin__InfluenzaB__AHL92244

SEQ ID NO: 180475 - RNA, 1758 nt, Artificial Sequence; identical to SEQ ID NO: 179034
  derived and/or modified sequence opt4 from hemagglutinin__InfluenzaB__AHL92255

SEQ ID NO: 180476 - RNA, 1758 nt, Artificial Sequence; identical to SEQ ID NO: 179034
  derived and/or modified sequence opt4 from hemagglutinin__InfluenzaB__AHL92266

SEQ ID NO: 180477 - RNA, 1758 nt, Artificial Sequence
  derived and/or modified sequence opt4 from hemagglutinin__InfluenzaB__AHL92277
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccaccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180478 - RNA, 1758 nt, Artificial Sequence; identical to SEQ ID NO: 179034
  derived and/or modified sequence opt4 from hemagglutinin__InfluenzaB__AHL92288

SEQ ID NO: 180479 - RNA, 1758 nt, Artificial Sequence; identical to SEQ ID NO: 179034
  derived and/or modified sequence opt4 from hemagglutinin__InfluenzaB__AHL92299

SEQ ID NO: 180480 - RNA, 1755 nt, Artificial Sequence; identical to SEQ ID NO: 180152
  derived and/or modified sequence opt4 from hemagglutinin__InfluenzaB__AHL92310

SEQ ID NO: 180481 - RNA, 1755 nt, Artificial Sequence; identical to SEQ ID NO: 179087
  derived and/or modified sequence opt4 from hemagglutinin__InfluenzaB__AHL92321

SEQ ID NO: 180482 - RNA, 1755 nt, Artificial Sequence; identical to SEQ ID NO: 179087
  derived and/or modified sequence opt4 from hemagglutinin__InfluenzaB__AHL92332

SEQ ID NO: 180483 - RNA, 1755 nt, Artificial Sequence
  derived and/or modified sequence opt4 from hemagglutinin__InfluenzaB__AHL92354
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugguggacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180484 - RNA, 1755 nt, Artificial Sequence; identical to SEQ ID NO: 180483
  derived and/or modified sequence opt4 from hemagglutinin__InfluenzaB__AHL92365

SEQ ID NO: 180485 - RNA, 1755 nt, Artificial Sequence; identical to SEQ ID NO: 179340
  derived and/or modified sequence opt4 from hemagglutinin__InfluenzaB__AHL92376

SEQ ID NO: 180486 - RNA, 1755 nt, Artificial Sequence; identical to SEQ ID NO: 179340
  derived and/or modified sequence opt4 from hemagglutinin__InfluenzaB__AHL92387

SEQ ID NO: 180487 - RNA, 1755 nt, Artificial Sequence; identical to SEQ ID NO: 179340
  derived and/or modified sequence opt4 from hemagglutinin__InfluenzaB__AHL92398

SEQ ID NO: 180488 - RNA, 1755 nt, Artificial Sequence; identical to SEQ ID NO: 179340
  derived and/or modified sequence opt4 from hemagglutinin__InfluenzaB__AHL92409

SEQ ID NO: 180489 - RNA, 1755 nt, Artificial Sequence; identical to SEQ ID NO: 179340
  derived and/or modified sequence opt4 from hemagglutinin__InfluenzaB__AHL92420

SEQ ID NO: 180490 - RNA, 1755 nt, Artificial Sequence; identical to SEQ ID NO: 179087
  derived and/or modified sequence opt4 from hemagglutinin__InfluenzaB__AHL92431

SEQ ID NO: 180491 - RNA, 1755 nt, Artificial Sequence; identical to SEQ ID NO: 179340
  derived and/or modified sequence opt4 from hemagglutinin__InfluenzaB__AHL92442

SEQ ID NO: 180492 - RNA, 1755 nt, Artificial Sequence; identical to SEQ ID NO: 179340
  derived and/or modified sequence opt4 from hemagglutinin__InfluenzaB__AHL92453

SEQ ID NO: 180493 - RNA, 1755 nt, Artificial Sequence; identical to SEQ ID NO: 179340
  derived and/or modified sequence opt4 from hemagglutinin__InfluenzaB__AHL92464

SEQ ID NO: 180494 - RNA, 1755 nt, Artificial Sequence
  derived and/or modified sequence opt4 from hemagglutinin__InfluenzaB__AHL92475
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccaggccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180495 - RNA, 1755 nt, Artificial Sequence; identical to SEQ ID NO: 179087
  derived and/or modified sequence opt4 from hemagglutinin__InfluenzaB__AHL92486

SEQ ID NO: 180496 - RNA, 1755 nt, Artificial Sequence; identical to SEQ ID NO: 179340
  derived and/or modified sequence opt4 from hemagglutinin__InfluenzaB__AHL92497

SEQ ID NO: 180497 - RNA, 1755 nt, Artificial Sequence; identical to SEQ ID NO: 179340
  derived and/or modified sequence opt4 from hemagglutinin__InfluenzaB__AHL92508

SEQ ID NO: 180498 - RNA, 1755 nt, Artificial Sequence; identical to SEQ ID NO: 179340
  derived and/or modified sequence opt4 from hemagglutinin__InfluenzaB__AHL92519

SEQ ID NO: 180499 - RNA, 1755 nt, Artificial Sequence; identical to SEQ ID NO: 179340
  derived and/or modified sequence opt4 from hemagglutinin__InfluenzaB__AHL92530

SEQ ID NO: 180500 - RNA, 1755 nt, Artificial Sequence; identical to SEQ ID NO: 179087
  derived and/or modified sequence opt4 from hemagglutinin__InfluenzaB__AHL92541

SEQ ID NO: 180501 - RNA, 1752 nt, Artificial Sequence
  derived and/or modified sequence opt4 from hemagglutinin__InfluenzaB__AHL92563
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaagaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180502 - RNA, 1755 nt, Artificial Sequence; identical to SEQ ID NO: 179340
  derived and/or modified sequence opt4 from hemagglutinin__InfluenzaB__AHL92574

SEQ ID NO: 180503 - RNA, 1755 nt, Artificial Sequence
  derived and/or modified sequence opt4 from hemagglutinin__InfluenzaB__AHL92585
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcgccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180504 - RNA, 1755 nt, Artificial Sequence; identical to SEQ ID NO: 179340
  derived and/or modified sequence opt4 from hemagglutinin__InfluenzaB__AHL92596

SEQ ID NO: 180505 - RNA, 1755 nt, Artificial Sequence; identical to SEQ ID NO: 179087
  derived and/or modified sequence opt4 from hemagglutinin__InfluenzaB__AHL92607

SEQ ID NO: 180506 - RNA, 1755 nt, Artificial Sequence
  derived and/or modified sequence opt4 from hemagglutinin__InfluenzaB__AHL92629
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccgagaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180507 - RNA, 1755 nt, Artificial Sequence; identical to SEQ ID NO: 179087
  derived and/or modified sequence opt4 from hemagglutinin__InfluenzaB__AHL92640

SEQ ID NO: 180508 - RNA, 1755 nt, Artificial Sequence; identical to SEQ ID NO: 179087
  derived and/or modified sequence opt4 from hemagglutinin__InfluenzaB__AHL92651

SEQ ID NO: 180509 - RNA, 1755 nt, Artificial Sequence
  derived and/or modified sequence opt4 from hemagglutinin__InfluenzaB__AHL92684
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaucauccugcuguacuacagcaccgccgccagcagccuggccgugacccugaugcuggccaucuucaucguguacauggugagcagagacaacgugagcugcagcaucugccuguga

SEQ ID NO: 180510 - RNA, 1755 nt, Artificial Sequence; identical to SEQ ID NO: 179340
  derived and/or modified sequence opt4 from hemagglutinin__InfluenzaB__AHL92695

SEQ ID NO: 180511 - RNA, 1755 nt, Artificial Sequence; identical to SEQ ID NO: 179340
  derived and/or modified sequence opt4 from hemagglutinin__InfluenzaB__AHL92706

SEQ ID NO: 180512 - RNA, 1755 nt, Artificial Sequence
  derived and/or modified sequence opt4 from hemagglutinin__InfluenzaB__AHL92728
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagaucaucgagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180513 - RNA, 1755 nt, Artificial Sequence; identical to SEQ ID NO: 180512
  derived and/or modified sequence opt4 from hemagglutinin__InfluenzaB__AHL92739

SEQ ID NO: 180514 - RNA, 1755 nt, Artificial Sequence; identical to SEQ ID NO: 180512
  derived and/or modified sequence opt4 from hemagglutinin__InfluenzaB__AHL92750

SEQ ID NO: 180515 - RNA, 1755 nt, Artificial Sequence; identical to SEQ ID NO: 179340
  derived and/or modified sequence opt4 from hemagglutinin__InfluenzaB__AHL92761

SEQ ID NO: 180516 - RNA, 1755 nt, Artificial Sequence
  derived and/or modified sequence opt4 from hemagglutinin__InfluenzaB__AHL92772
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcaugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180517 - RNA, 1755 nt, Artificial Sequence; identical to SEQ ID NO: 179340
  derived and/or modified sequence opt4 from hemagglutinin__InfluenzaB__AHL92794

SEQ ID NO: 180518 - RNA, 1755 nt, Artificial Sequence; identical to SEQ ID NO: 179340
  derived and/or modified sequence opt4 from hemagglutinin__InfluenzaB__AHL92805

SEQ ID NO: 180519 - RNA, 1755 nt, Artificial Sequence; identical to SEQ ID NO: 179340
  derived and/or modified sequence opt4 from hemagglutinin__InfluenzaB__AHL92816

SEQ ID NO: 180520 - RNA, 1755 nt, Artificial Sequence
  derived and/or modified sequence opt4 from hemagglutinin__InfluenzaB__AHL92827
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucgugguguacauggugagcagagacaacgugagcugcagcaucugccuguga

SEQ ID NO: 180521 - RNA, 1755 nt, Artificial Sequence; identical to SEQ ID NO: 179340
  derived and/or modified sequence opt4 from hemagglutinin__InfluenzaB__AHL92838

SEQ ID NO: 180522 - RNA, 1755 nt, Artificial Sequence; identical to SEQ ID NO: 179340
  derived and/or modified sequence opt4 from hemagglutinin__InfluenzaB__AHL92849

SEQ ID NO: 180523 - RNA, 1755 nt, Artificial Sequence; identical to SEQ ID NO: 179340
  derived and/or modified sequence opt4 from hemagglutinin__InfluenzaB__AHL92860

SEQ ID NO: 180524 - RNA, 1758 nt, Artificial Sequence; identical to SEQ ID NO: 179158
  derived and/or modified sequence opt4 from hemagglutinin__InfluenzaB__AHL92871

SEQ ID NO: 180525 - RNA, 1755 nt, Artificial Sequence; identical to SEQ ID NO: 178946
  derived and/or modified sequence opt4 from hemagglutinin__InfluenzaB__AHL92882

SEQ ID NO: 180526 - RNA, 1758 nt, Artificial Sequence
  derived and/or modified sequence opt4 from hemagglutinin__InfluenzaB__AHL92893
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaaggagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180527 - RNA, 1755 nt, Artificial Sequence; identical to SEQ ID NO: 179543
  derived and/or modified sequence opt4 from hemagglutinin__InfluenzaB__AHL92904

SEQ ID NO: 180528 - RNA, 1758 nt, Artificial Sequence
  derived and/or modified sequence opt4 from hemagglutinin__InfluenzaB__AHL92915
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 180529 - RNA, 1758 nt, Artificial Sequence; identical to SEQ ID NO: 179158
  derived and/or modified sequence opt4 from hemagglutinin__InfluenzaB__AHL92926

SEQ ID NO: 180530 - RNA, 1755 nt, Artificial Sequence; identical to SEQ ID NO: 180119
  derived and/or modified sequence opt4 from hemagglutinin__InfluenzaB__AHL92937

SEQ ID NO: 180531 - RNA, 1758 nt, Artificial Sequence; identical to SEQ ID NO: 179034
  derived and/or modified sequence opt4 from hemagglutinin__InfluenzaB__AHL92948

SEQ ID NO: 180532 - RNA, 1758 nt, Artificial Sequence; identical to SEQ ID NO: 179034
  derived and/or modified sequence opt4 from hemagglutinin__InfluenzaB__AHL92959

SEQ ID NO: 180533 - RNA, 1758 nt, Artificial Sequence; identical to SEQ ID NO: 179034
  derived and/or modified sequence opt4 from hemagglutinin__InfluenzaB__AHL92970

SEQ ID NO: 180534 - RNA, 1758 nt, Artificial Sequence; identical to SEQ ID NO: 179034
  derived and/or modified sequence opt4 from hemagglutinin__InfluenzaB__AHL92981

SEQ ID NO: 180535 - RNA, 1758 nt, Artificial Sequence; identical to SEQ ID NO: 179034
  derived and/or modified sequence opt4 from hemagglutinin__InfluenzaB__AHL92992

SEQ ID NO: 180536 - RNA, 1758 nt, Artificial Sequence; identical to SEQ ID NO: 180459
  derived and/or modified sequence opt4 from hemagglutinin__InfluenzaB__AHL93004

SEQ ID NO: 180537 - RNA, 1758 nt, Artificial Sequence; identical to SEQ ID NO: 179034
  derived and/or modified sequence opt4 from hemagglutinin__InfluenzaB__AHL93015

SEQ ID NO: 180538 - RNA, 1758 nt, Artificial Sequence; identical to SEQ ID NO: 179034
  derived and/or modified sequence opt4 from hemagglutinin__InfluenzaB__AHL93026

SEQ ID NO: 180539 - RNA, 1755 nt, Artificial Sequence; identical to SEQ ID NO: 180483
  derived and/or modified sequence opt4 from hemagglutinin__InfluenzaB__AHL93037

SEQ ID NO: 180540 - RNA, 1755 nt, Artificial Sequence; identical to SEQ ID NO: 180483
  derived and/or modified sequence opt4 from hemagglutinin__InfluenzaB__AHL93048

SEQ ID NO: 180541 - RNA, 1755 nt, Artificial Sequence; identical to SEQ ID NO: 180512
  derived and/or modified sequence opt4 from hemagglutinin__InfluenzaB__AHL93059

SEQ ID NO: 180542 - RNA, 1755 nt, Artificial Sequence; identical to SEQ ID NO: 179340
  derived and/or modified sequence opt4 from hemagglutinin__InfluenzaB__AHL93070

SEQ ID NO: 180543 - RNA, 1755 nt, Artificial Sequence
  derived and/or modified sequence opt4 from hemagglutinin__InfluenzaB__AHL93081
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacggcaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180544 - RNA, 1755 nt, Artificial Sequence; identical to SEQ ID NO: 179340
  derived and/or modified sequence opt4 from hemagglutinin__InfluenzaB__AHL93092

SEQ ID NO: 180545 - RNA, 1755 nt, Artificial Sequence; identical to SEQ ID NO: 179340
  derived and/or modified sequence opt4 from hemagglutinin__InfluenzaB__AHL93103

SEQ ID NO: 180546 - RNA, 1755 nt, Artificial Sequence; identical to SEQ ID NO: 179340
  derived and/or modified sequence opt4 from hemagglutinin__InfluenzaB__AHL93114

SEQ ID NO: 180547 - RNA, 1755 nt, Artificial Sequence; identical to SEQ ID NO: 179087
  derived and/or modified sequence opt4 from hemagglutinin__InfluenzaB__AHL93125

SEQ ID NO: 180548 - RNA, 1755 nt, Artificial Sequence
  derived and/or modified sequence opt4 from hemagglutinin__InfluenzaB__AHL93136
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180549 - RNA, 1755 nt, Artificial Sequence; identical to SEQ ID NO: 179087
  derived and/or modified sequence opt4 from hemagglutinin__InfluenzaB__AHL93147

SEQ ID NO: 180550 - RNA, 1755 nt, Artificial Sequence; identical to SEQ ID NO: 179340
  derived and/or modified sequence opt4 from hemagglutinin__InfluenzaB__AHL93158

SEQ ID NO: 180551 - RNA, 1755 nt, Artificial Sequence
  derived and/or modified sequence opt4 from hemagglutinin__InfluenzaB__AHL93169
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugcuucaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180552 - RNA, 1755 nt, Artificial Sequence
  derived and/or modified sequence opt4 from hemagglutinin__InfluenzaB__AHL93180
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucauccacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcagcuuccccgaccagaccgaggacggcggccugccccagagcggcagaaucgugguggacuacaugaugcagaagcccggcaagaccggcaccaucguguaccagagaggcgugcugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180553 - RNA, 1755 nt, Artificial Sequence
  derived and/or modified sequence opt4 from hemagglutinin__InfluenzaB__AHL93191
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgacaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180554 - RNA, 1755 nt, Artificial Sequence
  derived and/or modified sequence opt4 from hemagglutinin__InfluenzaB__AHL93202
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgaguuccacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180555 - RNA, 1758 nt, Artificial Sequence; identical to SEQ ID NO: 179509
  derived and/or modified sequence opt4 from hemagglutinin__InfluenzaB__AHL93213

SEQ ID NO: 180556 - RNA, 1758 nt, Artificial Sequence; identical to SEQ ID NO: 179509
  derived and/or modified sequence opt4 from hemagglutinin__InfluenzaB__AHL93224

SEQ ID NO: 180557 - RNA, 1758 nt, Artificial Sequence
  derived and/or modified sequence opt4 from hemagglutinin__InfluenzaB__AHL93235
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacaacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180558 - RNA, 1758 nt, Artificial Sequence
  derived and/or modified sequence opt4 from hemagglutinin__InfluenzaB__AHL93246
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacagccugaccaucgaggugcccuacaucugcaccgagggcgaggaccagaucaccaucuggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugggcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180559 - RNA, 1758 nt, Artificial Sequence; identical to SEQ ID NO: 179509
  derived and/or modified sequence opt4 from hemagglutinin__InfluenzaB__AHL93257

SEQ ID NO: 180560 - RNA, 1758 nt, Artificial Sequence; identical to SEQ ID NO: 179842
  derived and/or modified sequence opt4 from hemagglutinin__InfluenzaB__AHL93268

SEQ ID NO: 180561 - RNA, 1758 nt, Artificial Sequence
  derived and/or modified sequence opt4 from hemagglutinin__InfluenzaB__AHL93279
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcaagagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180562 - RNA, 1758 nt, Artificial Sequence; identical to SEQ ID NO: 179509
  derived and/or modified sequence opt4 from hemagglutinin__InfluenzaB__AHL93290

SEQ ID NO: 180563 - RNA, 1758 nt, Artificial Sequence
  derived and/or modified sequence opt4 from hemagglutinin__InfluenzaB__AHL93301
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180564 - RNA, 1758 nt, Artificial Sequence
  derived and/or modified sequence opt4 from hemagglutinin__InfluenzaB__AHL93312
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuacgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180565 - RNA, 1758 nt, Artificial Sequence
  derived and/or modified sequence opt4 from hemagglutinin__InfluenzaB__AHL93323
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180566 - RNA, 1758 nt, Artificial Sequence
  derived and/or modified sequence opt4 from hemagglutinin__InfluenzaB__AHL93334
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180567 - RNA, 1758 nt, Artificial Sequence; identical to SEQ ID NO: 179509
  derived and/or modified sequence opt4 from hemagglutinin__InfluenzaB__AHL93345

SEQ ID NO: 180568 - RNA, 1758 nt, Artificial Sequence; identical to SEQ ID NO: 179509
  derived and/or modified sequence opt4 from hemagglutinin__InfluenzaB__AHL93356

SEQ ID NO: 180569 - RNA, 1758 nt, Artificial Sequence
  derived and/or modified sequence opt4 from hemagglutinin__InfluenzaB__AHL93367
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgaguacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180570 - RNA, 1758 nt, Artificial Sequence; identical to SEQ ID NO: 179509
  derived and/or modified sequence opt4 from hemagglutinin__InfluenzaB__AHL93378

SEQ ID NO: 180571 - RNA, 1758 nt, Artificial Sequence
  derived and/or modified sequence opt4 from hemagglutinin__InfluenzaB__AHL93389
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180572 - RNA, 1758 nt, Artificial Sequence; identical to SEQ ID NO: 179509
  derived and/or modified sequence opt4 from hemagglutinin__InfluenzaB__AHL93400

SEQ ID NO: 180573 - RNA, 1758 nt, Artificial Sequence; identical to SEQ ID NO: 179842
  derived and/or modified sequence opt4 from hemagglutinin__InfluenzaB__AHL93411

SEQ ID NO: 180574 - RNA, 1758 nt, Artificial Sequence; identical to SEQ ID NO: 179842
  derived and/or modified sequence opt4 from hemagglutinin__InfluenzaB__AHL93422

SEQ ID NO: 180575 - RNA, 1758 nt, Artificial Sequence; identical to SEQ ID NO: 179842
  derived and/or modified sequence opt4 from hemagglutinin__InfluenzaB__AHL93433

SEQ ID NO: 180576 - RNA, 1758 nt, Artificial Sequence; identical to SEQ ID NO: 179509
  derived and/or modified sequence opt4 from hemagglutinin__InfluenzaB__AHL93444

SEQ ID NO: 180577 - RNA, 1758 nt, Artificial Sequence
  derived and/or modified sequence opt4 from hemagglutinin__InfluenzaB__AHL93455
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccaugaacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180578 - RNA, 1758 nt, Artificial Sequence; identical to SEQ ID NO: 179509
  derived and/or modified sequence opt4 from hemagglutinin__InfluenzaB__AHL93466

SEQ ID NO: 180579 - RNA, 1758 nt, Artificial Sequence; identical to SEQ ID NO: 179128
  derived and/or modified sequence opt4 from hemagglutinin__InfluenzaB__AHL93477

SEQ ID NO: 180580 - RNA, 1758 nt, Artificial Sequence; identical to SEQ ID NO: 179203
  derived and/or modified sequence opt4 from hemagglutinin__InfluenzaB__AHL93488

SEQ ID NO: 180581 - RNA, 1755 nt, Artificial Sequence
  derived and/or modified sequence opt4 from hemagglutinin__InfluenzaB__AHL93499
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgagaucagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccgcccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180582 - RNA, 1758 nt, Artificial Sequence; identical to SEQ ID NO: 179128
  derived and/or modified sequence opt4 from hemagglutinin__InfluenzaB__AHL93510

SEQ ID NO: 180583 - RNA, 1755 nt, Artificial Sequence
  derived and/or modified sequence opt4 from hemagglutinin__InfluenzaB__AHL93521
augaaggccaucaucgcccugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagagauucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180584 - RNA, 1758 nt, Artificial Sequence; identical to SEQ ID NO: 179203
  derived and/or modified sequence opt4 from hemagglutinin__InfluenzaB__AHL93532

SEQ ID NO: 180585 - RNA, 1758 nt, Artificial Sequence; identical to SEQ ID NO: 179165
  derived and/or modified sequence opt4 from hemagglutinin__InfluenzaB__AHL93543

SEQ ID NO: 180586 - RNA, 1758 nt, Artificial Sequence; identical to SEQ ID NO: 179165
  derived and/or modified sequence opt4 from hemagglutinin__InfluenzaB__AHL93554

SEQ ID NO: 180587 - RNA, 1758 nt, Artificial Sequence; identical to SEQ ID NO: 179165
  derived and/or modified sequence opt4 from hemagglutinin__InfluenzaB__AHL93565

SEQ ID NO: 180588 - RNA, 1758 nt, Artificial Sequence; identical to SEQ ID NO: 179203
  derived and/or modified sequence opt4 from hemagglutinin__InfluenzaB__AHL93576

SEQ ID NO: 180589 - RNA, 1758 nt, Artificial Sequence; identical to SEQ ID NO: 179203
  derived and/or modified sequence opt4 from hemagglutinin__InfluenzaB__AHL93587

SEQ ID NO: 180590 - RNA, 1758 nt, Artificial Sequence
  derived and/or modified sequence opt4 from hemagglutinin__InfluenzaB__AHL93609
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaccgagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180591 - RNA, 1758 nt, Artificial Sequence; identical to SEQ ID NO: 179203
  derived and/or modified sequence opt4 from hemagglutinin__InfluenzaB__AHL93620

SEQ ID NO: 180592 - RNA, 1758 nt, Artificial Sequence; identical to SEQ ID NO: 180590
  derived and/or modified sequence opt4 from hemagglutinin__InfluenzaB__AHL93631

SEQ ID NO: 180593 - RNA, 1758 nt, Artificial Sequence; identical to SEQ ID NO: 180590
  derived and/or modified sequence opt4 from hemagglutinin__InfluenzaB__AHL93642

SEQ ID NO: 180594 - RNA, 1755 nt, Artificial Sequence
  derived and/or modified sequence opt4 from hemagglutinin__InfluenzaB__AHL93653
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcgacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180595 - RNA, 1758 nt, Artificial Sequence; identical to SEQ ID NO: 179203
  derived and/or modified sequence opt4 from hemagglutinin__InfluenzaB__AHL93664

SEQ ID NO: 180596 - RNA, 1758 nt, Artificial Sequence; identical to SEQ ID NO: 179128
  derived and/or modified sequence opt4 from hemagglutinin__InfluenzaB__AHL93675

SEQ ID NO: 180597 - RNA, 1758 nt, Artificial Sequence; identical to SEQ ID NO: 180590
  derived and/or modified sequence opt4 from hemagglutinin__InfluenzaB__AHL93686

SEQ ID NO: 180598 - RNA, 1758 nt, Artificial Sequence; identical to SEQ ID NO: 180590
  derived and/or modified sequence opt4 from hemagglutinin__InfluenzaB__AHL93697

SEQ ID NO: 180599 - RNA, 1758 nt, Artificial Sequence
  derived and/or modified sequence opt4 from hemagglutinin__InfluenzaB__AHL93708
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcaagcacgccaaggccaucggcaacugccccaucugggugaagaccccccugaagcuggccaacggcaccaaguacagaccccccgccaagcugcugaccgagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180600 - RNA, 1758 nt, Artificial Sequence
  derived and/or modified sequence opt4 from hemagglutinin__InfluenzaB__AHL93719
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugauccccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180601 - RNA, 1758 nt, Artificial Sequence; identical to SEQ ID NO: 179203
  derived and/or modified sequence opt4 from hemagglutinin__InfluenzaB__AHL93730

SEQ ID NO: 180602 - RNA, 1758 nt, Artificial Sequence; identical to SEQ ID NO: 179203
  derived and/or modified sequence opt4 from hemagglutinin__InfluenzaB__AHL93741

SEQ ID NO: 180603 - RNA, 1758 nt, Artificial Sequence; identical to SEQ ID NO: 179165
  derived and/or modified sequence opt4 from hemagglutinin__InfluenzaB__AHL93752

SEQ ID NO: 180604 - RNA, 1758 nt, Artificial Sequence; identical to SEQ ID NO: 180590
  derived and/or modified sequence opt4 from hemagglutinin__InfluenzaB__AHL93763

SEQ ID NO: 180605 - RNA, 1758 nt, Artificial Sequence; identical to SEQ ID NO: 179128
  derived and/or modified sequence opt4 from hemagglutinin__InfluenzaB__AHL93774

SEQ ID NO: 180606 - RNA, 1758 nt, Artificial Sequence; identical to SEQ ID NO: 180590
  derived and/or modified sequence opt4 from hemagglutinin__InfluenzaB__AHL93785

SEQ ID NO: 180607 - RNA, 1758 nt, Artificial Sequence; identical to SEQ ID NO: 179203
  derived and/or modified sequence opt4 from hemagglutinin__InfluenzaB__AHL93796

SEQ ID NO: 180608 - RNA, 1758 nt, Artificial Sequence; identical to SEQ ID NO: 179128
  derived and/or modified sequence opt4 from hemagglutinin__InfluenzaB__AHL93818

SEQ ID NO: 180609 - RNA, 1758 nt, Artificial Sequence
  derived and/or modified sequence opt4 from hemagglutinin__InfluenzaB__AHL93829
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacaccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180610 - RNA, 1758 nt, Artificial Sequence; identical to SEQ ID NO: 179509
  derived and/or modified sequence opt4 from hemagglutinin__InfluenzaB__AHL93840

SEQ ID NO: 180611 - RNA, 1758 nt, Artificial Sequence; identical to SEQ ID NO: 179203
  derived and/or modified sequence opt4 from hemagglutinin__InfluenzaB__AHL93851

SEQ ID NO: 180612 - RNA, 1758 nt, Artificial Sequence; identical to SEQ ID NO: 179203
  derived and/or modified sequence opt4 from hemagglutinin__InfluenzaB__AHL93862

SEQ ID NO: 180613 - RNA, 1758 nt, Artificial Sequence
  derived and/or modified sequence opt4 from hemagglutinin__InfluenzaB__AHL93873
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcgagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180614 - RNA, 1758 nt, Artificial Sequence; identical to SEQ ID NO: 179203
  derived and/or modified sequence opt4 from hemagglutinin__InfluenzaB__AHL93884

SEQ ID NO: 180615 - RNA, 1758 nt, Artificial Sequence; identical to SEQ ID NO: 179203
  derived and/or modified sequence opt4 from hemagglutinin__InfluenzaB__AHL93895

SEQ ID NO: 180616 - RNA, 1758 nt, Artificial Sequence; identical to SEQ ID NO: 179203
  derived and/or modified sequence opt4 from hemagglutinin__InfluenzaB__AHL93906

SEQ ID NO: 180617 - RNA, 1758 nt, Artificial Sequence; identical to SEQ ID NO: 179203
  derived and/or modified sequence opt4 from hemagglutinin__InfluenzaB__AHL93917

SEQ ID NO: 180618 - RNA, 1758 nt, Artificial Sequence; identical to SEQ ID NO: 179128
  derived and/or modified sequence opt4 from hemagglutinin__InfluenzaB__AHL93928

SEQ ID NO: 180619 - RNA, 1758 nt, Artificial Sequence; identical to SEQ ID NO: 179165
  derived and/or modified sequence opt4 from hemagglutinin__InfluenzaB__AHL93939

SEQ ID NO: 180620 - RNA, 1758 nt, Artificial Sequence; identical to SEQ ID NO: 179203
  derived and/or modified sequence opt4 from hemagglutinin__InfluenzaB__AHL93950

SEQ ID NO: 180621 - RNA, 1758 nt, Artificial Sequence; identical to SEQ ID NO: 179165
  derived and/or modified sequence opt4 from hemagglutinin__InfluenzaB__AHL93961

SEQ ID NO: 180622 - RNA, 1758 nt, Artificial Sequence
  derived and/or modified sequence opt4 from hemagglutinin__InfluenzaB__AHL93972
augaaggccaucaucgugcugcugaugguggugaccagcaccgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccgugggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180623 - RNA, 1758 nt, Artificial Sequence; identical to SEQ ID NO: 179128
  derived and/or modified sequence opt4 from hemagglutinin__InfluenzaB__AHL93983

SEQ ID NO: 180624 - RNA, 1755 nt, Artificial Sequence
  derived and/or modified sequence opt4 from hemagglutinin__InfluenzaB__AHL93994
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaagaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacaugaucagcagagacaacgugagcugcagcaucugccuguga

SEQ ID NO: 180625 - RNA, 1758 nt, Artificial Sequence; identical to SEQ ID NO: 179203
  derived and/or modified sequence opt4 from hemagglutinin__InfluenzaB__AHL94005

SEQ ID NO: 180626 - RNA, 1758 nt, Artificial Sequence; identical to SEQ ID NO: 179203
  derived and/or modified sequence opt4 from hemagglutinin__InfluenzaB__AHL94016

SEQ ID NO: 180627 - RNA, 1758 nt, Artificial Sequence
  derived and/or modified sequence opt4 from hemagglutinin__InfluenzaB__AHL94027
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagaugggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180628 - RNA, 1758 nt, Artificial Sequence; identical to SEQ ID NO: 179165
  derived and/or modified sequence opt4 from hemagglutinin__InfluenzaB__AHL94038

SEQ ID NO: 180629 - RNA, 1758 nt, Artificial Sequence; identical to SEQ ID NO: 179128
  derived and/or modified sequence opt4 from hemagglutinin__InfluenzaB__AHL94049

SEQ ID NO: 180630 - RNA, 1758 nt, Artificial Sequence; identical to SEQ ID NO: 179203
  derived and/or modified sequence opt4 from hemagglutinin__InfluenzaB__AHL94060

SEQ ID NO: 180631 - RNA, 1758 nt, Artificial Sequence
  derived and/or modified sequence opt4 from hemagglutinin__InfluenzaB__AHL94071
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacaugaugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucagcaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180632 - RNA, 1755 nt, Artificial Sequence
  derived and/or modified sequence opt4 from hemagglutinin__InfluenzaB__AHL94082
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgagaucagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180633 - RNA, 1758 nt, Artificial Sequence; identical to SEQ ID NO: 179165
  derived and/or modified sequence opt4 from hemagglutinin__InfluenzaB__AHL94093

SEQ ID NO: 180634 - RNA, 1758 nt, Artificial Sequence; identical to SEQ ID NO: 179203
  derived and/or modified sequence opt4 from hemagglutinin__InfluenzaB__AHL94102

SEQ ID NO: 180635 - RNA, 1758 nt, Artificial Sequence
  derived and/or modified sequence opt4 from hemagglutinin__InfluenzaB__AHL94113
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccugaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180636 - RNA, 1758 nt, Artificial Sequence
  derived and/or modified sequence opt4 from hemagglutinin__InfluenzaB__AHL94124
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgagaucagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180637 - RNA, 1758 nt, Artificial Sequence; identical to SEQ ID NO: 179128
  derived and/or modified sequence opt4 from hemagglutinin__InfluenzaB__AHL94135

SEQ ID NO: 180638 - RNA, 1758 nt, Artificial Sequence; identical to SEQ ID NO: 179128
  derived and/or modified sequence opt4 from hemagglutinin__InfluenzaB__AHL94146

SEQ ID NO: 180639 - RNA, 1758 nt, Artificial Sequence; identical to SEQ ID NO: 179203
  derived and/or modified sequence opt4 from hemagglutinin__InfluenzaB__AHL94157

SEQ ID NO: 180640 - RNA, 1758 nt, Artificial Sequence; identical to SEQ ID NO: 179203
  derived and/or modified sequence opt4 from hemagglutinin__InfluenzaB__AHL94168

SEQ ID NO: 180641 - RNA, 1758 nt, Artificial Sequence; identical to SEQ ID NO: 179128
  derived and/or modified sequence opt4 from hemagglutinin__InfluenzaB__AHL94179

SEQ ID NO: 180642 - RNA, 1758 nt, Artificial Sequence; identical to SEQ ID NO: 179128
  derived and/or modified sequence opt4 from hemagglutinin__InfluenzaB__AHL94190

SEQ ID NO: 180643 - RNA, 1758 nt, Artificial Sequence
  derived and/or modified sequence opt4 from hemagglutinin__InfluenzaB__AHL94201
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgagaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagaaacaacgugagcugcagcaucugccuguga

SEQ ID NO: 180644 - RNA, 1758 nt, Artificial Sequence
  derived and/or modified sequence opt4 from hemagglutinin__InfluenzaB__AHL94212
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccaggugaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180645 - RNA, 1758 nt, Artificial Sequence; identical to SEQ ID NO: 179203
  derived and/or modified sequence opt4 from hemagglutinin__InfluenzaB__AHL94220

SEQ ID NO: 180646 - RNA, 1758 nt, Artificial Sequence; identical to SEQ ID NO: 179203
  derived and/or modified sequence opt4 from hemagglutinin__InfluenzaB__AHL94231

SEQ ID NO: 180647 - RNA, 1758 nt, Artificial Sequence
  derived and/or modified sequence opt4 from hemagglutinin__InfluenzaB__AHL94242
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccaacggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180648 - RNA, 1758 nt, Artificial Sequence; identical to SEQ ID NO: 179165
  derived and/or modified sequence opt4 from hemagglutinin__InfluenzaB__AHL94253

SEQ ID NO: 180649 - RNA, 1755 nt, Artificial Sequence
  derived and/or modified sequence opt4 from hemagglutinin__InfluenzaB__AHL94274
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180650 - RNA, 1755 nt, Artificial Sequence; identical to SEQ ID NO: 180649
  derived and/or modified sequence opt4 from hemagglutinin__InfluenzaB__AHL94295

SEQ ID NO: 180651 - RNA, 1755 nt, Artificial Sequence
  derived and/or modified sequence opt4 from hemagglutinin__InfluenzaB__AHL94306
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180652 - RNA, 1755 nt, Artificial Sequence
  derived and/or modified sequence opt4 from hemagglutinin__InfluenzaB__AHL94317
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagcuacuucgccaaccugaagggcaucagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccagagacaacuacaagaacgccaccaacccccagaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180653 - RNA, 1755 nt, Artificial Sequence; identical to SEQ ID NO: 180651
  derived and/or modified sequence opt4 from hemagglutinin__InfluenzaB__AHL94328

SEQ ID NO: 180654 - RNA, 1755 nt, Artificial Sequence; identical to SEQ ID NO: 180649
  derived and/or modified sequence opt4 from hemagglutinin__InfluenzaB__AHL94339

SEQ ID NO: 180655 - RNA, 1758 nt, Artificial Sequence
  derived and/or modified sequence opt4 from hemagglutinin__InfluenzaB__AHL94350
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcaaggacaacgugagcugcagcaucugccuguga

SEQ ID NO: 180656 - RNA, 1758 nt, Artificial Sequence
  derived and/or modified sequence opt4 from hemagglutinin__InfluenzaB__AHL94361
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucgccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacagcgugagcugcagcaucugccuguga

SEQ ID NO: 180657 - RNA, 1758 nt, Artificial Sequence
  derived and/or modified sequence opt4 from hemagglutinin__InfluenzaB__AHL94383
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggagaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180658 - RNA, 1758 nt, Artificial Sequence; identical to SEQ ID NO: 179165
  derived and/or modified sequence opt4 from hemagglutinin__InfluenzaB__AHL94394

SEQ ID NO: 180659 - RNA, 1758 nt, Artificial Sequence
  derived and/or modified sequence opt4 from hemagglutinin__InfluenzaB__AHL94405
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180660 - RNA, 1758 nt, Artificial Sequence; identical to SEQ ID NO: 179165
  derived and/or modified sequence opt4 from hemagglutinin__InfluenzaB__AHL94416

SEQ ID NO: 180661 - RNA, 1755 nt, Artificial Sequence; identical to SEQ ID NO: 179374
  derived and/or modified sequence opt4 from hemagglutinin__InfluenzaB__AHL94427

SEQ ID NO: 180662 - RNA, 1755 nt, Artificial Sequence
  derived and/or modified sequence opt4 from hemagglutinin__InfluenzaB__AHL94438
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgagaccauggccugggccgugcccaaggacaacuacaagaacgccaccaacccccagaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180663 - RNA, 1755 nt, Artificial Sequence
  derived and/or modified sequence opt4 from hemagglutinin__InfluenzaB__AHL94460
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgaggaggaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180664 - RNA, 1755 nt, Artificial Sequence
  derived and/or modified sequence opt4 from hemagglutinin__InfluenzaB__AHL94471
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacaucagcugcagcaucugccuguga

SEQ ID NO: 180665 - RNA, 1758 nt, Artificial Sequence
  derived and/or modified sequence opt4 from hemagglutinin__InfluenzaB__AHL94482
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucaccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180666 - RNA, 1755 nt, Artificial Sequence; identical to SEQ ID NO: 180649
  derived and/or modified sequence opt4 from hemagglutinin__InfluenzaB__AHL94493

SEQ ID NO: 180667 - RNA, 1755 nt, Artificial Sequence; identical to SEQ ID NO: 180651
  derived and/or modified sequence opt4 from hemagglutinin__InfluenzaB__AHL94504

SEQ ID NO: 180668 - RNA, 1758 nt, Artificial Sequence
  derived and/or modified sequence opt4 from hemagglutinin__InfluenzaB__AHL94515
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcaccuacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggagaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180669 - RNA, 1755 nt, Artificial Sequence; identical to SEQ ID NO: 180651
  derived and/or modified sequence opt4 from hemagglutinin__InfluenzaB__AHL94526

SEQ ID NO: 180670 - RNA, 1758 nt, Artificial Sequence
  derived and/or modified sequence opt4 from hemagglutinin__InfluenzaB__AHL94537
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacaucagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180671 - RNA, 1755 nt, Artificial Sequence
  derived and/or modified sequence opt4 from hemagglutinin__InfluenzaB__AHL94548
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaucaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagagagcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180672 - RNA, 1755 nt, Artificial Sequence; identical to SEQ ID NO: 180649
  derived and/or modified sequence opt4 from hemagglutinin__InfluenzaB__AHL94559

SEQ ID NO: 180673 - RNA, 1755 nt, Artificial Sequence; identical to SEQ ID NO: 179374
  derived and/or modified sequence opt4 from hemagglutinin__InfluenzaB__AHL94570

SEQ ID NO: 180674 - RNA, 1755 nt, Artificial Sequence; identical to SEQ ID NO: 179374
  derived and/or modified sequence opt4 from hemagglutinin__InfluenzaB__AHL94581

SEQ ID NO: 180675 - RNA, 1755 nt, Artificial Sequence; identical to SEQ ID NO: 179374
  derived and/or modified sequence opt4 from hemagglutinin__InfluenzaB__AHL94592

SEQ ID NO: 180676 - RNA, 1758 nt, Artificial Sequence
  derived and/or modified sequence opt4 from hemagglutinin__InfluenzaB__AHL94603
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagaacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180677 - RNA, 1758 nt, Artificial Sequence
  derived and/or modified sequence opt4 from hemagglutinin__InfluenzaB__AHL94614
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaucagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180678 - RNA, 1755 nt, Artificial Sequence; identical to SEQ ID NO: 180651
  derived and/or modified sequence opt4 from hemagglutinin__InfluenzaB__AHL94624

SEQ ID NO: 180679 - RNA, 1758 nt, Artificial Sequence
  derived and/or modified sequence opt4 from hemagglutinin__InfluenzaB__AHL94646
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccugaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180680 - RNA, 1758 nt, Artificial Sequence
  derived and/or modified sequence opt4 from hemagglutinin__InfluenzaB__AHL94657
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagcgcccccggcggccccuacaagaucggcaccagcggcagcugccccaacgugaccaacggcaacggcuucuucgccaccauggccugggccgugcccaagaacgacaagaacaagaccgccaccgacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180681 - RNA, 1755 nt, Artificial Sequence; identical to SEQ ID NO: 180651
  derived and/or modified sequence opt4 from hemagglutinin__InfluenzaB__AHL94668

SEQ ID NO: 180682 - RNA, 1755 nt, Artificial Sequence; identical to SEQ ID NO: 180651
  derived and/or modified sequence opt4 from hemagglutinin__InfluenzaB__AHL94679

SEQ ID NO: 180683 - RNA, 1758 nt, Artificial Sequence; identical to SEQ ID NO: 180676
  derived and/or modified sequence opt4 from hemagglutinin__InfluenzaB__AHL94690

SEQ ID NO: 180684 - RNA, 1758 nt, Artificial Sequence
  derived and/or modified sequence opt4 from hemagglutinin__InfluenzaB__AHL94701
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccugaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccugaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180685 - RNA, 1755 nt, Artificial Sequence; identical to SEQ ID NO: 180649
  derived and/or modified sequence opt4 from hemagglutinin__InfluenzaB__AHL94712

SEQ ID NO: 180686 - RNA, 1758 nt, Artificial Sequence; identical to SEQ ID NO: 180680
  derived and/or modified sequence opt4 from hemagglutinin__InfluenzaB__AHL94723

SEQ ID NO: 180687 - RNA, 1755 nt, Artificial Sequence; identical to SEQ ID NO: 180649
  derived and/or modified sequence opt4 from hemagglutinin__InfluenzaB__AHL94734

SEQ ID NO: 180688 - RNA, 1758 nt, Artificial Sequence
  derived and/or modified sequence opt4 from hemagglutinin__InfluenzaB__AHL94745
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccugaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacggcgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180689 - RNA, 1755 nt, Artificial Sequence; identical to SEQ ID NO: 179374
  derived and/or modified sequence opt4 from hemagglutinin__InfluenzaB__AHL94756

SEQ ID NO: 180690 - RNA, 1758 nt, Artificial Sequence; identical to SEQ ID NO: 180679
  derived and/or modified sequence opt4 from hemagglutinin__InfluenzaB__AHL94766

SEQ ID NO: 180691 - RNA, 1755 nt, Artificial Sequence
  derived and/or modified sequence opt4 from hemagglutinin__InfluenzaB__AHL94777
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagcuacuucgccaaccugaagggcaccagaaccagaggcaagcugugccccgacugcuucaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgccaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180692 - RNA, 1758 nt, Artificial Sequence; identical to SEQ ID NO: 180676
  derived and/or modified sequence opt4 from hemagglutinin__InfluenzaB__AHL94797

SEQ ID NO: 180693 - RNA, 1755 nt, Artificial Sequence
  derived and/or modified sequence opt4 from hemagglutinin__InfluenzaB__AHL94808
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagcuacuucgccaaccugaagggcaucagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180694 - RNA, 1755 nt, Artificial Sequence
  derived and/or modified sequence opt4 from hemagglutinin__InfluenzaB__AHL94817
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagaucaucgagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180695 - RNA, 1758 nt, Artificial Sequence; identical to SEQ ID NO: 180385
  derived and/or modified sequence opt4 from hemagglutinin__InfluenzaB__AHL94827

SEQ ID NO: 180696 - RNA, 1755 nt, Artificial Sequence
  derived and/or modified sequence opt4 from hemagglutinin__InfluenzaB__AHL94837
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccgccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacaagcugggcaccagcggcagcugccccaacgccaccagcaagaucggcuucuucgccaccauggccugggccgugcccaaggacaacuacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180697 - RNA, 1755 nt, Artificial Sequence; identical to SEQ ID NO: 179374
  derived and/or modified sequence opt4 from hemagglutinin__InfluenzaB__AHL94847

SEQ ID NO: 180698 - RNA, 1758 nt, Artificial Sequence
  derived and/or modified sequence opt4 from hemagglutinin__InfluenzaB__AHL94858
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaaggccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180699 - RNA, 1755 nt, Artificial Sequence; identical to SEQ ID NO: 179340
  derived and/or modified sequence opt4 from hemagglutinin__InfluenzaB__AHL94869

SEQ ID NO: 180700 - RNA, 1758 nt, Artificial Sequence; identical to SEQ ID NO: 179509
  derived and/or modified sequence opt4 from hemagglutinin__InfluenzaB__AHL94880

SEQ ID NO: 180701 - RNA, 1758 nt, Artificial Sequence; identical to SEQ ID NO: 179842
  derived and/or modified sequence opt4 from hemagglutinin__InfluenzaB__AHL94889

SEQ ID NO: 180702 - RNA, 1758 nt, Artificial Sequence; identical to SEQ ID NO: 179509
  derived and/or modified sequence opt4 from hemagglutinin__InfluenzaB__AHL94900

SEQ ID NO: 180703 - RNA, 1758 nt, Artificial Sequence
  derived and/or modified sequence opt4 from hemagglutinin__InfluenzaB__AHL94911
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcagaaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180704 - RNA, 1758 nt, Artificial Sequence; identical to SEQ ID NO: 179509
  derived and/or modified sequence opt4 from hemagglutinin__InfluenzaB__AHL94922

SEQ ID NO: 180705 - RNA, 1758 nt, Artificial Sequence
  derived and/or modified sequence opt4 from hemagglutinin__InfluenzaB__AHL94933
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaaggccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180706 - RNA, 1758 nt, Artificial Sequence; identical to SEQ ID NO: 180590
  derived and/or modified sequence opt4 from hemagglutinin__InfluenzaB__AHL94944

SEQ ID NO: 180707 - RNA, 1758 nt, Artificial Sequence; identical to SEQ ID NO: 179203
  derived and/or modified sequence opt4 from hemagglutinin__InfluenzaB__AHL94955

SEQ ID NO: 180708 - RNA, 1758 nt, Artificial Sequence; identical to SEQ ID NO: 179203
  derived and/or modified sequence opt4 from hemagglutinin__InfluenzaB__AHL94965

SEQ ID NO: 180709 - RNA, 1758 nt, Artificial Sequence; identical to SEQ ID NO: 179203
  derived and/or modified sequence opt4 from hemagglutinin__InfluenzaB__AHL94975

SEQ ID NO: 180710 - RNA, 1755 nt, Artificial Sequence; identical to SEQ ID NO: 179374
  derived and/or modified sequence opt4 from hemagglutinin__InfluenzaB__AHM00986

SEQ ID NO: 180711 - RNA, 1758 nt, Artificial Sequence; identical to SEQ ID NO: 179407
  derived and/or modified sequence opt4 from hemagglutinin__InfluenzaB__AHM00997

SEQ ID NO: 180712 - RNA, 1758 nt, Artificial Sequence
  derived and/or modified sequence opt4 from hemagglutinin__InfluenzaB__AHM01008
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccuggaccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180713 - RNA, 1758 nt, Artificial Sequence; identical to SEQ ID NO: 179407
  derived and/or modified sequence opt4 from hemagglutinin__InfluenzaB__AHM01019

SEQ ID NO: 180714 - RNA, 1758 nt, Artificial Sequence; identical to SEQ ID NO: 179407
  derived and/or modified sequence opt4 from hemagglutinin__InfluenzaB__AHM01030

SEQ ID NO: 180715 - RNA, 1758 nt, Artificial Sequence
  derived and/or modified sequence opt4 from hemagglutinin__InfluenzaB__AHM01041
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcgagaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180716 - RNA, 1758 nt, Artificial Sequence
  derived and/or modified sequence opt4 from hemagglutinin__InfluenzaB__AHM01052
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccaucaugcuguacuacagcaccgccgccagcagccuggccgugacccugaugaucgccaucuucgugguguacauggugagcagagacaacgugagcugcagcaucugccuguga

SEQ ID NO: 180717 - RNA, 1758 nt, Artificial Sequence; identical to SEQ ID NO: 179407
  derived and/or modified sequence opt4 from hemagglutinin__InfluenzaB__AHM01063

SEQ ID NO: 180718 - RNA, 1755 nt, Artificial Sequence; identical to SEQ ID NO: 179374
  derived and/or modified sequence opt4 from hemagglutinin__InfluenzaB__AHM01074

SEQ ID NO: 180719 - RNA, 1755 nt, Artificial Sequence
  derived and/or modified sequence opt4 from hemagglutinin__InfluenzaB__AHM01096
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180720 - RNA, 1758 nt, Artificial Sequence; identical to SEQ ID NO: 179407
  derived and/or modified sequence opt4 from hemagglutinin__InfluenzaB__AHM01107

SEQ ID NO: 180721 - RNA, 1758 nt, Artificial Sequence
  derived and/or modified sequence opt4 from hemagglutinin__InfluenzaB__AHM01118
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgugagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180722 - RNA, 1758 nt, Artificial Sequence; identical to SEQ ID NO: 179407
  derived and/or modified sequence opt4 from hemagglutinin__InfluenzaB__AHM01129

SEQ ID NO: 180723 - RNA, 1758 nt, Artificial Sequence
  derived and/or modified sequence opt4 from hemagglutinin__InfluenzaB__AHM01140
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcgcccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180724 - RNA, 1758 nt, Artificial Sequence; identical to SEQ ID NO: 179392
  derived and/or modified sequence opt4 from hemagglutinin__InfluenzaB__AHM01151

SEQ ID NO: 180725 - RNA, 1758 nt, Artificial Sequence
  derived and/or modified sequence opt4 from hemagglutinin__InfluenzaB__AHM01162
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccaaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180726 - RNA, 1755 nt, Artificial Sequence; identical to SEQ ID NO: 179374
  derived and/or modified sequence opt4 from hemagglutinin__InfluenzaB__AHM01173

SEQ ID NO: 180727 - RNA, 1758 nt, Artificial Sequence
  derived and/or modified sequence opt4 from hemagglutinin__InfluenzaB__AHM01184
augaaggccaucaucgugcugcugaugguggugaccagcaacgccgacagaaucugcaccggcaucaccagcagcaacagcccccacguggugaagaccgccacccagggcgaggugaacgugaccggcgugaucacccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180728 - RNA, 1758 nt, Artificial Sequence; identical to SEQ ID NO: 180723
  derived and/or modified sequence opt4 from hemagglutinin__InfluenzaB__AHM01195

SEQ ID NO: 180729 - RNA, 1758 nt, Artificial Sequence
  derived and/or modified sequence opt4 from hemagglutinin__InfluenzaB__AHM01206
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcgagaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccugggcaaccacaccauccugcuguacuacagcaccgccgccagcagccuggccgugacccugaugaucgccaucuucgugguguacauggugagcagagacaacgugagcugcagcaucugccuguga

SEQ ID NO: 180730 - RNA, 1758 nt, Artificial Sequence; identical to SEQ ID NO: 179392
  derived and/or modified sequence opt4 from hemagglutinin__InfluenzaB__AHM01217

SEQ ID NO: 180731 - RNA, 1755 nt, Artificial Sequence; identical to SEQ ID NO: 179374
  derived and/or modified sequence opt4 from hemagglutinin__InfluenzaB__AHM01228

SEQ ID NO: 180732 - RNA, 1758 nt, Artificial Sequence; identical to SEQ ID NO: 179407
  derived and/or modified sequence opt4 from hemagglutinin__InfluenzaB__AHM01239

SEQ ID NO: 180733 - RNA, 1758 nt, Artificial Sequence; identical to SEQ ID NO: 179407
  derived and/or modified sequence opt4 from hemagglutinin__InfluenzaB__AHM01250

SEQ ID NO: 180734 - RNA, 1758 nt, Artificial Sequence
  derived and/or modified sequence opt4 from hemagglutinin__InfluenzaB__AHM01261
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccaucuggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccggcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180735 - RNA, 1755 nt, Artificial Sequence; identical to SEQ ID NO: 179374
  derived and/or modified sequence opt4 from hemagglutinin__InfluenzaB__AHM01272

SEQ ID NO: 180736 - RNA, 1758 nt, Artificial Sequence; identical to SEQ ID NO: 180723
  derived and/or modified sequence opt4 from hemagglutinin__InfluenzaB__AHM01283

SEQ ID NO: 180737 - RNA, 1758 nt, Artificial Sequence; identical to SEQ ID NO: 180723
  derived and/or modified sequence opt4 from hemagglutinin__InfluenzaB__AHM01294

SEQ ID NO: 180738 - RNA, 1755 nt, Artificial Sequence; identical to SEQ ID NO: 179374
  derived and/or modified sequence opt4 from hemagglutinin__InfluenzaB__AHM01305

SEQ ID NO: 180739 - RNA, 1758 nt, Artificial Sequence; identical to SEQ ID NO: 179407
  derived and/or modified sequence opt4 from hemagglutinin__InfluenzaB__AHM01316

SEQ ID NO: 180740 - RNA, 1758 nt, Artificial Sequence; identical to SEQ ID NO: 180723
  derived and/or modified sequence opt4 from hemagglutinin__InfluenzaB__AHM01327

SEQ ID NO: 180741 - RNA, 1758 nt, Artificial Sequence; identical to SEQ ID NO: 179407
  derived and/or modified sequence opt4 from hemagglutinin__InfluenzaB__AHM01338

SEQ ID NO: 180742 - RNA, 1758 nt, Artificial Sequence; identical to SEQ ID NO: 179407
  derived and/or modified sequence opt4 from hemagglutinin__InfluenzaB__AHM01349

SEQ ID NO: 180743 - RNA, 1758 nt, Artificial Sequence
  derived and/or modified sequence opt4 from hemagglutinin__InfluenzaB__AHM01360
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccaagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180744 - RNA, 1755 nt, Artificial Sequence
  derived and/or modified sequence opt4 from hemagglutinin__InfluenzaB__AHM01371
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagaacggcuucuucgccaccauggccugggccgugcccaaggacaacaacaagaacgccaccaacccccugaccguggaggugcccuacaucugcgccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180745 - RNA, 1755 nt, Artificial Sequence; identical to SEQ ID NO: 179374
  derived and/or modified sequence opt4 from hemagglutinin__InfluenzaB__AHM01382

SEQ ID NO: 180746 - RNA, 1758 nt, Artificial Sequence
  derived and/or modified sequence opt4 from hemagglutinin__InfluenzaB__AHM01393
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180747 - RNA, 1758 nt, Artificial Sequence; identical to SEQ ID NO: 179407
  derived and/or modified sequence opt4 from hemagglutinin__InfluenzaB__AHM01404

SEQ ID NO: 180748 - RNA, 1758 nt, Artificial Sequence
  derived and/or modified sequence opt4 from hemagglutinin__InfluenzaB__AHM01415
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugaucgacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180749 - RNA, 1758 nt, Artificial Sequence
  derived and/or modified sequence opt4 from hemagglutinin__InfluenzaB__AHM01426
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccaucuggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180750 - RNA, 1755 nt, Artificial Sequence
  derived and/or modified sequence opt4 from hemagglutinin__InfluenzaB__AHM01437
augaaggccgugaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180751 - RNA, 1755 nt, Artificial Sequence
  derived and/or modified sequence opt4 from hemagglutinin__InfluenzaB__AHM01448
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccgccgaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180752 - RNA, 1758 nt, Artificial Sequence; identical to SEQ ID NO: 179165
  derived and/or modified sequence opt4 from hemagglutinin__InfluenzaB__AHM01459

SEQ ID NO: 180753 - RNA, 1755 nt, Artificial Sequence
  derived and/or modified sequence opt4 from hemagglutinin__InfluenzaB__AHM01470
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucgccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccgugaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180754 - RNA, 1755 nt, Artificial Sequence
  derived and/or modified sequence opt4 from hemagglutinin__InfluenzaB__AHM01481
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagagaguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180755 - RNA, 1755 nt, Artificial Sequence; identical to SEQ ID NO: 179419
  derived and/or modified sequence opt4 from hemagglutinin__InfluenzaB__AHM01492

SEQ ID NO: 180756 - RNA, 1755 nt, Artificial Sequence; identical to SEQ ID NO: 179374
  derived and/or modified sequence opt4 from hemagglutinin__InfluenzaB__AHM01503

SEQ ID NO: 180757 - RNA, 1755 nt, Artificial Sequence; identical to SEQ ID NO: 179374
  derived and/or modified sequence opt4 from hemagglutinin__InfluenzaB__AHM01514

SEQ ID NO: 180758 - RNA, 1755 nt, Artificial Sequence
  derived and/or modified sequence opt4 from hemagglutinin__InfluenzaB__AHM01525
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180759 - RNA, 1755 nt, Artificial Sequence
  derived and/or modified sequence opt4 from hemagglutinin__InfluenzaB__AHM01536
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgugcacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180760 - RNA, 1755 nt, Artificial Sequence; identical to SEQ ID NO: 179374
  derived and/or modified sequence opt4 from hemagglutinin__InfluenzaB__AHM01547

SEQ ID NO: 180761 - RNA, 1755 nt, Artificial Sequence; identical to SEQ ID NO: 179419
  derived and/or modified sequence opt4 from hemagglutinin__InfluenzaB__AHM01558

SEQ ID NO: 180762 - RNA, 1758 nt, Artificial Sequence; identical to SEQ ID NO: 179260
  derived and/or modified sequence opt4 from hemagglutinin__InfluenzaB__AHV83951

SEQ ID NO: 180763 - RNA, 1755 nt, Artificial Sequence; identical to SEQ ID NO: 180649
  derived and/or modified sequence opt4 from hemagglutinin__InfluenzaB__AHV83952

SEQ ID NO: 180764 - RNA, 1758 nt, Artificial Sequence; identical to SEQ ID NO: 179203
  derived and/or modified sequence opt4 from hemagglutinin__InfluenzaB__AHZ36697

SEQ ID NO: 180765 - RNA, 1758 nt, Artificial Sequence
  derived and/or modified sequence opt4 from hemagglutinin__InfluenzaB__AHZ36708
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccugaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcaccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180766 - RNA, 1758 nt, Artificial Sequence
  derived and/or modified sequence opt4 from hemagglutinin__InfluenzaB__AHZ36719
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacgugugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180767 - RNA, 1758 nt, Artificial Sequence; identical to SEQ ID NO: 179203
  derived and/or modified sequence opt4 from hemagglutinin__InfluenzaB__AHZ36730

SEQ ID NO: 180768 - RNA, 1758 nt, Artificial Sequence; identical to SEQ ID NO: 179203
  derived and/or modified sequence opt4 from hemagglutinin__InfluenzaB__AHZ36752

SEQ ID NO: 180769 - RNA, 1758 nt, Artificial Sequence; identical to SEQ ID NO: 179165
  derived and/or modified sequence opt4 from hemagglutinin__InfluenzaB__AHZ36763

SEQ ID NO: 180770 - RNA, 1758 nt, Artificial Sequence
  derived and/or modified sequence opt4 from hemagglutinin__InfluenzaB__AHZ36774
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagcgcccccggcggccccuacaagaucggcaccagcggcagcugccccaacgugaccaacggcaacggcuucuucgccaccauggccugggccgugcccaagaacgacaagaacaagaccgccaccgacccccugaccaucgaggugcccuacaucugcaccgaggaggaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaaggugaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180771 - RNA, 1758 nt, Artificial Sequence; identical to SEQ ID NO: 180679
  derived and/or modified sequence opt4 from hemagglutinin__InfluenzaB__AHZ36785

SEQ ID NO: 180772 - RNA, 1758 nt, Artificial Sequence; identical to SEQ ID NO: 180679
  derived and/or modified sequence opt4 from hemagglutinin__InfluenzaB__AHZ36796

SEQ ID NO: 180773 - RNA, 1755 nt, Artificial Sequence
  derived and/or modified sequence opt4 from hemagglutinin__InfluenzaB__AHZ36807
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccgagaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180774 - RNA, 1758 nt, Artificial Sequence; identical to SEQ ID NO: 179203
  derived and/or modified sequence opt4 from hemagglutinin__InfluenzaB__AHZ36818

SEQ ID NO: 180775 - RNA, 1758 nt, Artificial Sequence; identical to SEQ ID NO: 179165
  derived and/or modified sequence opt4 from hemagglutinin__InfluenzaB__AHZ36829

SEQ ID NO: 180776 - RNA, 1758 nt, Artificial Sequence; identical to SEQ ID NO: 179165
  derived and/or modified sequence opt4 from hemagglutinin__InfluenzaB__AHZ36840

SEQ ID NO: 180777 - RNA, 1758 nt, Artificial Sequence; identical to SEQ ID NO: 180679
  derived and/or modified sequence opt4 from hemagglutinin__InfluenzaB__AHZ36851

SEQ ID NO: 180778 - RNA, 1758 nt, Artificial Sequence; identical to SEQ ID NO: 179203
  derived and/or modified sequence opt4 from hemagglutinin__InfluenzaB__AHZ36862

SEQ ID NO: 180779 - RNA, 1758 nt, Artificial Sequence; identical to SEQ ID NO: 179165
  derived and/or modified sequence opt4 from hemagglutinin__InfluenzaB__AHZ36873

SEQ ID NO: 180780 - RNA, 1758 nt, Artificial Sequence
  derived and/or modified sequence opt4 from hemagglutinin__InfluenzaB__AHZ36884
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgagaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180781 - RNA, 1758 nt, Artificial Sequence; identical to SEQ ID NO: 179203
  derived and/or modified sequence opt4 from hemagglutinin__InfluenzaB__AHZ36895

SEQ ID NO: 180782 - RNA, 1758 nt, Artificial Sequence; identical to SEQ ID NO: 179203
  derived and/or modified sequence opt4 from hemagglutinin__InfluenzaB__AHZ36906

SEQ ID NO: 180783 - RNA, 1758 nt, Artificial Sequence
  derived and/or modified sequence opt4 from hemagglutinin__InfluenzaB__AHZ36928
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccugaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180784 - RNA, 1758 nt, Artificial Sequence; identical to SEQ ID NO: 180679
  derived and/or modified sequence opt4 from hemagglutinin__InfluenzaB__AHZ36939

SEQ ID NO: 180785 - RNA, 1758 nt, Artificial Sequence
  derived and/or modified sequence opt4 from hemagglutinin__InfluenzaB__AHZ36950
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccaucaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180786 - RNA, 1758 nt, Artificial Sequence
  derived and/or modified sequence opt4 from hemagglutinin__InfluenzaB__AHZ36961
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcggcagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180787 - RNA, 1758 nt, Artificial Sequence; identical to SEQ ID NO: 179203
  derived and/or modified sequence opt4 from hemagglutinin__InfluenzaB__AHZ36972

SEQ ID NO: 180788 - RNA, 1758 nt, Artificial Sequence
  derived and/or modified sequence opt4 from hemagglutinin__InfluenzaB__AHZ36983
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccgcccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180789 - RNA, 1758 nt, Artificial Sequence
  derived and/or modified sequence opt4 from hemagglutinin__InfluenzaB__AHZ37005
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagcgcccccggcggccccuacaagaucggcaccagcggcagcugccccaacgugaccaacggcaacggcuucuucgccaccauggccugggccgugcccaagaacgacaagaacaagaccgccaccgacccccugaccaucgaggugcccuacaucugcaccgaggaggaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180790 - RNA, 1758 nt, Artificial Sequence; identical to SEQ ID NO: 179165
  derived and/or modified sequence opt4 from hemagglutinin__InfluenzaB__AHZ37016

SEQ ID NO: 180791 - RNA, 1758 nt, Artificial Sequence
  derived and/or modified sequence opt4 from hemagglutinin__InfluenzaB__AHZ37027
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcaucauccacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccugaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180792 - RNA, 1758 nt, Artificial Sequence; identical to SEQ ID NO: 179165
  derived and/or modified sequence opt4 from hemagglutinin__InfluenzaB__AHZ37038

SEQ ID NO: 180793 - RNA, 1758 nt, Artificial Sequence; identical to SEQ ID NO: 180679
  derived and/or modified sequence opt4 from hemagglutinin__InfluenzaB__AHZ37049

SEQ ID NO: 180794 - RNA, 1758 nt, Artificial Sequence; identical to SEQ ID NO: 180679
  derived and/or modified sequence opt4 from hemagglutinin__InfluenzaB__AHZ37060

SEQ ID NO: 180795 - RNA, 1758 nt, Artificial Sequence; identical to SEQ ID NO: 179165
  derived and/or modified sequence opt4 from hemagglutinin__InfluenzaB__AHZ37071

SEQ ID NO: 180796 - RNA, 1758 nt, Artificial Sequence; identical to SEQ ID NO: 179165
  derived and/or modified sequence opt4 from hemagglutinin__InfluenzaB__AHZ37082

SEQ ID NO: 180797 - RNA, 1758 nt, Artificial Sequence; identical to SEQ ID NO: 180679
  derived and/or modified sequence opt4 from hemagglutinin__InfluenzaB__AHZ37093

SEQ ID NO: 180798 - RNA, 1758 nt, Artificial Sequence
  derived and/or modified sequence opt4 from hemagglutinin__InfluenzaB__AHZ37104
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggaccacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180799 - RNA, 1758 nt, Artificial Sequence
  derived and/or modified sequence opt4 from hemagglutinin__InfluenzaB__AHZ41770
augaaggccaucaucgugcugcugaugguggugaccagcaacgccgacagaaucugcaccggcaucaccagcagcaacagcccccacaucgugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaucaacccccugaccaucgaggugcccuacaucugcaccgagggcgaggaccagaucaccguguggggcuuccacagcgacaacgagacccagauggccaagcuguacggcgacagcgagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180800 - RNA, 1758 nt, Artificial Sequence; identical to SEQ ID NO: 179203
  derived and/or modified sequence opt4 from hemagglutinin__InfluenzaB__AHZ41781

SEQ ID NO: 180801 - RNA, 1758 nt, Artificial Sequence; identical to SEQ ID NO: 179203
  derived and/or modified sequence opt4 from hemagglutinin__InfluenzaB__AHZ41792

SEQ ID NO: 180802 - RNA, 1758 nt, Artificial Sequence; identical to SEQ ID NO: 179203
  derived and/or modified sequence opt4 from hemagglutinin__InfluenzaB__AHZ41803

SEQ ID NO: 180803 - RNA, 1758 nt, Artificial Sequence
  derived and/or modified sequence opt4 from hemagglutinin__InfluenzaB__AHZ41814
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccgugaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180804 - RNA, 1758 nt, Artificial Sequence; identical to SEQ ID NO: 179203
  derived and/or modified sequence opt4 from hemagglutinin__InfluenzaB__AHZ41825

SEQ ID NO: 180805 - RNA, 1758 nt, Artificial Sequence; identical to SEQ ID NO: 179203
  derived and/or modified sequence opt4 from hemagglutinin__InfluenzaB__AHZ41836

SEQ ID NO: 180806 - RNA, 1758 nt, Artificial Sequence; identical to SEQ ID NO: 179203
  derived and/or modified sequence opt4 from hemagglutinin__InfluenzaB__AHZ41847

SEQ ID NO: 180807 - RNA, 1755 nt, Artificial Sequence; identical to SEQ ID NO: 180651
  derived and/or modified sequence opt4 from hemagglutinin__InfluenzaB__AHZ41858

SEQ ID NO: 180808 - RNA, 1758 nt, Artificial Sequence; identical to SEQ ID NO: 180676
  derived and/or modified sequence opt4 from hemagglutinin__InfluenzaB__AHZ41869

SEQ ID NO: 180809 - RNA, 1755 nt, Artificial Sequence
  derived and/or modified sequence opt4 from hemagglutinin__InfluenzaB__AIC73844
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180810 - RNA, 1758 nt, Artificial Sequence; identical to SEQ ID NO: 180385
  derived and/or modified sequence opt4 from hemagglutinin__InfluenzaB__AIC73845

SEQ ID NO: 180811 - RNA, 1758 nt, Artificial Sequence; identical to SEQ ID NO: 180385
  derived and/or modified sequence opt4 from hemagglutinin__InfluenzaB__AIC73846

SEQ ID NO: 180812 - RNA, 1758 nt, Artificial Sequence
  derived and/or modified sequence opt4 from hemagglutinin__InfluenzaB__AIC73847
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccuggacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180813 - RNA, 1758 nt, Artificial Sequence; identical to SEQ ID NO: 180385
  derived and/or modified sequence opt4 from hemagglutinin__InfluenzaB__AIC73848

SEQ ID NO: 180814 - RNA, 1755 nt, Artificial Sequence; identical to SEQ ID NO: 180649
  derived and/or modified sequence opt4 from hemagglutinin__InfluenzaB__AIC73849

SEQ ID NO: 180815 - RNA, 1758 nt, Artificial Sequence
  derived and/or modified sequence opt4 from hemagglutinin__InfluenzaB__AIC73850
augaaggccaucaucgugcugcugaugguggccaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180816 - RNA, 1758 nt, Artificial Sequence; identical to SEQ ID NO: 179407
  derived and/or modified sequence opt4 from hemagglutinin__InfluenzaB__AIC73851

SEQ ID NO: 180817 - RNA, 1755 nt, Artificial Sequence; identical to SEQ ID NO: 180809
  derived and/or modified sequence opt4 from hemagglutinin__InfluenzaB__AIC73852

SEQ ID NO: 180818 - RNA, 1755 nt, Artificial Sequence; identical to SEQ ID NO: 180809
  derived and/or modified sequence opt4 from hemagglutinin__InfluenzaB__AIC73853

SEQ ID NO: 180819 - RNA, 1758 nt, Artificial Sequence
  derived and/or modified sequence opt4 from hemagglutinin__InfluenzaB__AIC73855
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaucaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180820 - RNA, 1758 nt, Artificial Sequence; identical to SEQ ID NO: 180385
  derived and/or modified sequence opt4 from hemagglutinin__InfluenzaB__AIC73856

SEQ ID NO: 180821 - RNA, 1758 nt, Artificial Sequence; identical to SEQ ID NO: 180385
  derived and/or modified sequence opt4 from hemagglutinin__InfluenzaB__AIC73857

SEQ ID NO: 180822 - RNA, 1758 nt, Artificial Sequence; identical to SEQ ID NO: 180385
  derived and/or modified sequence opt4 from hemagglutinin__InfluenzaB__AIC73859

SEQ ID NO: 180823 - RNA, 1758 nt, Artificial Sequence
  derived and/or modified sequence opt4 from hemagglutinin__InfluenzaB__AIC73860
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaugagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180824 - RNA, 1758 nt, Artificial Sequence
  derived and/or modified sequence opt4 from hemagglutinin__InfluenzaB__AIC73861
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacaccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccauccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180825 - RNA, 1758 nt, Artificial Sequence; identical to SEQ ID NO: 180823
  derived and/or modified sequence opt4 from hemagglutinin__InfluenzaB__AIC73862

SEQ ID NO: 180826 - RNA, 1758 nt, Artificial Sequence; identical to SEQ ID NO: 180823
  derived and/or modified sequence opt4 from hemagglutinin__InfluenzaB__AIC73863

SEQ ID NO: 180827 - RNA, 1758 nt, Artificial Sequence; identical to SEQ ID NO: 180823
  derived and/or modified sequence opt4 from hemagglutinin__InfluenzaB__AIC73864

SEQ ID NO: 180828 - RNA, 1755 nt, Artificial Sequence
  derived and/or modified sequence opt4 from hemagglutinin__InfluenzaB__AIC73865
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagagagaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180829 - RNA, 1758 nt, Artificial Sequence
  derived and/or modified sequence opt4 from hemagglutinin__InfluenzaB__AIC73867
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucgacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180830 - RNA, 1758 nt, Artificial Sequence; identical to SEQ ID NO: 179407
  derived and/or modified sequence opt4 from hemagglutinin__InfluenzaB__AIC73868

SEQ ID NO: 180831 - RNA, 1758 nt, Artificial Sequence; identical to SEQ ID NO: 180823
  derived and/or modified sequence opt4 from hemagglutinin__InfluenzaB__AIC73869

SEQ ID NO: 180832 - RNA, 1758 nt, Artificial Sequence; identical to SEQ ID NO: 180823
  derived and/or modified sequence opt4 from hemagglutinin__InfluenzaB__AIC73870

SEQ ID NO: 180833 - RNA, 1758 nt, Artificial Sequence; identical to SEQ ID NO: 180385
  derived and/or modified sequence opt4 from hemagglutinin__InfluenzaB__AIC73871

SEQ ID NO: 180834 - RNA, 1755 nt, Artificial Sequence; identical to SEQ ID NO: 180809
  derived and/or modified sequence opt4 from hemagglutinin__InfluenzaB__AIC73872

SEQ ID NO: 180835 - RNA, 1755 nt, Artificial Sequence; identical to SEQ ID NO: 180649
  derived and/or modified sequence opt4 from hemagglutinin__InfluenzaB__AIC73873

SEQ ID NO: 180836 - RNA, 1755 nt, Artificial Sequence; identical to SEQ ID NO: 180809
  derived and/or modified sequence opt4 from hemagglutinin__InfluenzaB__AIC73874

SEQ ID NO: 180837 - RNA, 1755 nt, Artificial Sequence; identical to SEQ ID NO: 180828
  derived and/or modified sequence opt4 from hemagglutinin__InfluenzaB__AIC73875

SEQ ID NO: 180838 - RNA, 1755 nt, Artificial Sequence
  derived and/or modified sequence opt4 from hemagglutinin__InfluenzaB__AIC73876
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagagagaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccugaacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180839 - RNA, 1755 nt, Artificial Sequence; identical to SEQ ID NO: 180828
  derived and/or modified sequence opt4 from hemagglutinin__InfluenzaB__AIC73877

SEQ ID NO: 180840 - RNA, 1755 nt, Artificial Sequence; identical to SEQ ID NO: 180828
  derived and/or modified sequence opt4 from hemagglutinin__InfluenzaB__AIC73878

SEQ ID NO: 180841 - RNA, 1755 nt, Artificial Sequence; identical to SEQ ID NO: 180828
  derived and/or modified sequence opt4 from hemagglutinin__InfluenzaB__AIC73879

SEQ ID NO: 180842 - RNA, 1755 nt, Artificial Sequence; identical to SEQ ID NO: 180828
  derived and/or modified sequence opt4 from hemagglutinin__InfluenzaB__AIC73880

SEQ ID NO: 180843 - RNA, 1755 nt, Artificial Sequence; identical to SEQ ID NO: 180828
  derived and/or modified sequence opt4 from hemagglutinin__InfluenzaB__AIC73881

SEQ ID NO: 180844 - RNA, 1755 nt, Artificial Sequence; identical to SEQ ID NO: 180828
  derived and/or modified sequence opt4 from hemagglutinin__InfluenzaB__AIC73882

SEQ ID NO: 180845 - RNA, 1755 nt, Artificial Sequence; identical to SEQ ID NO: 180649
  derived and/or modified sequence opt4 from hemagglutinin__InfluenzaB__AIC73883

SEQ ID NO: 180846 - RNA, 1755 nt, Artificial Sequence; identical to SEQ ID NO: 180828
  derived and/or modified sequence opt4 from hemagglutinin__InfluenzaB__AIC73884

SEQ ID NO: 180847 - RNA, 1758 nt, Artificial Sequence
  derived and/or modified sequence opt4 from hemagglutinin__InfluenzaB__AIC73885
auggaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180848 - RNA, 1758 nt, Artificial Sequence; identical to SEQ ID NO: 180385
  derived and/or modified sequence opt4 from hemagglutinin__InfluenzaB__AIC73886

SEQ ID NO: 180849 - RNA, 1758 nt, Artificial Sequence; identical to SEQ ID NO: 180829
  derived and/or modified sequence opt4 from hemagglutinin__InfluenzaB__AIC73887

SEQ ID NO: 180850 - RNA, 1755 nt, Artificial Sequence; identical to SEQ ID NO: 180649
  derived and/or modified sequence opt4 from hemagglutinin__InfluenzaB__AIC73888

SEQ ID NO: 180851 - RNA, 1755 nt, Artificial Sequence; identical to SEQ ID NO: 180809
  derived and/or modified sequence opt4 from hemagglutinin__InfluenzaB__AIC73889

SEQ ID NO: 180852 - RNA, 1755 nt, Artificial Sequence; identical to SEQ ID NO: 180809
  derived and/or modified sequence opt4 from hemagglutinin__InfluenzaB__AIC73890

SEQ ID NO: 180853 - RNA, 1758 nt, Artificial Sequence
  derived and/or modified sequence opt4 from hemagglutinin__InfluenzaB__AIC73892
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccagccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180854 - RNA, 1755 nt, Artificial Sequence; identical to SEQ ID NO: 180649
  derived and/or modified sequence opt4 from hemagglutinin__InfluenzaB__AIC73893

SEQ ID NO: 180855 - RNA, 1755 nt, Artificial Sequence; identical to SEQ ID NO: 180809
  derived and/or modified sequence opt4 from hemagglutinin__InfluenzaB__AIC73894

SEQ ID NO: 180856 - RNA, 1755 nt, Artificial Sequence; identical to SEQ ID NO: 180809
  derived and/or modified sequence opt4 from hemagglutinin__InfluenzaB__AIC73895

SEQ ID NO: 180857 - RNA, 1755 nt, Artificial Sequence; identical to SEQ ID NO: 180809
  derived and/or modified sequence opt4 from hemagglutinin__InfluenzaB__AIC73896

SEQ ID NO: 180858 - RNA, 1755 nt, Artificial Sequence; identical to SEQ ID NO: 180809
  derived and/or modified sequence opt4 from hemagglutinin__InfluenzaB__AIC73897

SEQ ID NO: 180859 - RNA, 1755 nt, Artificial Sequence; identical to SEQ ID NO: 180809
  derived and/or modified sequence opt4 from hemagglutinin__InfluenzaB__AIC73898

SEQ ID NO: 180860 - RNA, 1755 nt, Artificial Sequence; identical to SEQ ID NO: 180809
  derived and/or modified sequence opt4 from hemagglutinin__InfluenzaB__AIC73899

SEQ ID NO: 180861 - RNA, 1755 nt, Artificial Sequence; identical to SEQ ID NO: 180809
  derived and/or modified sequence opt4 from hemagglutinin__InfluenzaB__AIC73900

SEQ ID NO: 180862 - RNA, 1755 nt, Artificial Sequence; identical to SEQ ID NO: 180809
  derived and/or modified sequence opt4 from hemagglutinin__InfluenzaB__AIC73902

SEQ ID NO: 180863 - RNA, 1755 nt, Artificial Sequence
  derived and/or modified sequence opt4 from hemagglutinin__InfluenzaB__AIC73903
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcaucaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180864 - RNA, 1755 nt, Artificial Sequence
  derived and/or modified sequence opt4 from hemagglutinin__InfluenzaB__AIC73904
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180865 - RNA, 1755 nt, Artificial Sequence; identical to SEQ ID NO: 180809
  derived and/or modified sequence opt4 from hemagglutinin__InfluenzaB__AIC73905

SEQ ID NO: 180866 - RNA, 1755 nt, Artificial Sequence; identical to SEQ ID NO: 180809
  derived and/or modified sequence opt4 from hemagglutinin__InfluenzaB__AIC73906

SEQ ID NO: 180867 - RNA, 1755 nt, Artificial Sequence; identical to SEQ ID NO: 180809
  derived and/or modified sequence opt4 from hemagglutinin__InfluenzaB__AIC73907

SEQ ID NO: 180868 - RNA, 1755 nt, Artificial Sequence; identical to SEQ ID NO: 180809
  derived and/or modified sequence opt4 from hemagglutinin__InfluenzaB__AIC73908

SEQ ID NO: 180869 - RNA, 1755 nt, Artificial Sequence; identical to SEQ ID NO: 180809
  derived and/or modified sequence opt4 from hemagglutinin__InfluenzaB__AIC73909

SEQ ID NO: 180870 - RNA, 1755 nt, Artificial Sequence; identical to SEQ ID NO: 180809
  derived and/or modified sequence opt4 from hemagglutinin__InfluenzaB__AIC73910

SEQ ID NO: 180871 - RNA, 1755 nt, Artificial Sequence; identical to SEQ ID NO: 180809
  derived and/or modified sequence opt4 from hemagglutinin__InfluenzaB__AIC73911

SEQ ID NO: 180872 - RNA, 1755 nt, Artificial Sequence; identical to SEQ ID NO: 180809
  derived and/or modified sequence opt4 from hemagglutinin__InfluenzaB__AIC73912

SEQ ID NO: 180873 - RNA, 1755 nt, Artificial Sequence; identical to SEQ ID NO: 180809
  derived and/or modified sequence opt4 from hemagglutinin__InfluenzaB__AIC73913

SEQ ID NO: 180874 - RNA, 1755 nt, Artificial Sequence; identical to SEQ ID NO: 180809
  derived and/or modified sequence opt4 from hemagglutinin__InfluenzaB__AIC73914

SEQ ID NO: 180875 - RNA, 1755 nt, Artificial Sequence; identical to SEQ ID NO: 180809
  derived and/or modified sequence opt4 from hemagglutinin__InfluenzaB__AIC73915

SEQ ID NO: 180876 - RNA, 1755 nt, Artificial Sequence; identical to SEQ ID NO: 180809
  derived and/or modified sequence opt4 from hemagglutinin__InfluenzaB__AIC73916

SEQ ID NO: 180877 - RNA, 1755 nt, Artificial Sequence; identical to SEQ ID NO: 180809
  derived and/or modified sequence opt4 from hemagglutinin__InfluenzaB__AIC73917

SEQ ID NO: 180878 - RNA, 1755 nt, Artificial Sequence; identical to SEQ ID NO: 180809
  derived and/or modified sequence opt4 from hemagglutinin__InfluenzaB__AIC73918

SEQ ID NO: 180879 - RNA, 1755 nt, Artificial Sequence; identical to SEQ ID NO: 180649
  derived and/or modified sequence opt4 from hemagglutinin__InfluenzaB__AIC73919

SEQ ID NO: 180880 - RNA, 1755 nt, Artificial Sequence; identical to SEQ ID NO: 180809
  derived and/or modified sequence opt4 from hemagglutinin__InfluenzaB__AIC73920

SEQ ID NO: 180881 - RNA, 1758 nt, Artificial Sequence; identical to SEQ ID NO: 180385
  derived and/or modified sequence opt4 from hemagglutinin__InfluenzaB__AIC73921

SEQ ID NO: 180882 - RNA, 1755 nt, Artificial Sequence; identical to SEQ ID NO: 180809
  derived and/or modified sequence opt4 from hemagglutinin__InfluenzaB__AIC73922

SEQ ID NO: 180883 - RNA, 1758 nt, Artificial Sequence; identical to SEQ ID NO: 179407
  derived and/or modified sequence opt4 from hemagglutinin__InfluenzaB__AIC73924

SEQ ID NO: 180884 - RNA, 1758 nt, Artificial Sequence
  derived and/or modified sequence opt4 from hemagglutinin__InfluenzaB__AIC73925
augaaggccaccaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180885 - RNA, 1755 nt, Artificial Sequence; identical to SEQ ID NO: 180809
  derived and/or modified sequence opt4 from hemagglutinin__InfluenzaB__AIC73926

SEQ ID NO: 180886 - RNA, 1755 nt, Artificial Sequence; identical to SEQ ID NO: 179087
  derived and/or modified sequence opt4 from hemagglutinin__InfluenzaB__AIL94977

SEQ ID NO: 180887 - RNA, 1755 nt, Artificial Sequence; identical to SEQ ID NO: 179087
  derived and/or modified sequence opt4 from hemagglutinin__InfluenzaB__AIL94988

SEQ ID NO: 180888 - RNA, 1755 nt, Artificial Sequence
  derived and/or modified sequence opt4 from hemagglutinin__InfluenzaB__AIL94999
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaccggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180889 - RNA, 1755 nt, Artificial Sequence; identical to SEQ ID NO: 179087
  derived and/or modified sequence opt4 from hemagglutinin__InfluenzaB__AIL95010

SEQ ID NO: 180890 - RNA, 1755 nt, Artificial Sequence; identical to SEQ ID NO: 179340
  derived and/or modified sequence opt4 from hemagglutinin__InfluenzaB__AIL95021

SEQ ID NO: 180891 - RNA, 1758 nt, Artificial Sequence; identical to SEQ ID NO: 179168
  derived and/or modified sequence opt4 from hemagglutinin__InfluenzaB__AIL95032

SEQ ID NO: 180892 - RNA, 1755 nt, Artificial Sequence; identical to SEQ ID NO: 179340
  derived and/or modified sequence opt4 from hemagglutinin__InfluenzaB__AIL95043

SEQ ID NO: 180893 - RNA, 1758 nt, Artificial Sequence; identical to SEQ ID NO: 179214
  derived and/or modified sequence opt4 from hemagglutinin__InfluenzaB__AIL95054

SEQ ID NO: 180894 - RNA, 1758 nt, Artificial Sequence; identical to SEQ ID NO: 179168
  derived and/or modified sequence opt4 from hemagglutinin__InfluenzaB__AIL95065

SEQ ID NO: 180895 - RNA, 1758 nt, Artificial Sequence; identical to SEQ ID NO: 179165
  derived and/or modified sequence opt4 from hemagglutinin__InfluenzaB__AIL95076

SEQ ID NO: 180896 - RNA, 1758 nt, Artificial Sequence; identical to SEQ ID NO: 179168
  derived and/or modified sequence opt4 from hemagglutinin__InfluenzaB__AIL95087

SEQ ID NO: 180897 - RNA, 1755 nt, Artificial Sequence; identical to SEQ ID NO: 179340
  derived and/or modified sequence opt4 from hemagglutinin__InfluenzaB__AIL95098

SEQ ID NO: 180898 - RNA, 1758 nt, Artificial Sequence; identical to SEQ ID NO: 180679
  derived and/or modified sequence opt4 from hemagglutinin__InfluenzaB__AIL95109

SEQ ID NO: 180899 - RNA, 1758 nt, Artificial Sequence
  derived and/or modified sequence opt4 from hemagglutinin__InfluenzaB__AIL95120
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacaagaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180900 - RNA, 1755 nt, Artificial Sequence; identical to SEQ ID NO: 180809
  derived and/or modified sequence opt4 from hemagglutinin__InfluenzaB__AKA54644

SEQ ID NO: 180901 - RNA, 1755 nt, Artificial Sequence
  derived and/or modified sequence opt4 from hemagglutinin__InfluenzaB__AKA54645
augaaggccaucaccgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagagccuguacggcgacagcaacccccagaaguucaccagcagcgccgacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180902 - RNA, 1755 nt, Artificial Sequence; identical to SEQ ID NO: 180809
  derived and/or modified sequence opt4 from hemagglutinin__InfluenzaB__AKA54646

SEQ ID NO: 180903 - RNA, 1755 nt, Artificial Sequence; identical to SEQ ID NO: 180809
  derived and/or modified sequence opt4 from hemagglutinin__InfluenzaB__AKA54647

SEQ ID NO: 180904 - RNA, 1758 nt, Artificial Sequence; identical to SEQ ID NO: 179407
  derived and/or modified sequence opt4 from hemagglutinin__InfluenzaB__AKA54648

SEQ ID NO: 180905 - RNA, 1755 nt, Artificial Sequence
  derived and/or modified sequence opt4 from hemagglutinin__InfluenzaB__AKA54649
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacaccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180906 - RNA, 1755 nt, Artificial Sequence; identical to SEQ ID NO: 180809
  derived and/or modified sequence opt4 from hemagglutinin__InfluenzaB__AKU40581

SEQ ID NO: 180907 - RNA, 1755 nt, Artificial Sequence; identical to SEQ ID NO: 180809
  derived and/or modified sequence opt4 from hemagglutinin__InfluenzaB__AKU40592

SEQ ID NO: 180908 - RNA, 1755 nt, Artificial Sequence; identical to SEQ ID NO: 180649
  derived and/or modified sequence opt4 from hemagglutinin__InfluenzaB__AKU40603

SEQ ID NO: 180909 - RNA, 1755 nt, Artificial Sequence; identical to SEQ ID NO: 180809
  derived and/or modified sequence opt4 from hemagglutinin__InfluenzaB__AKU40614

SEQ ID NO: 180910 - RNA, 1755 nt, Artificial Sequence; identical to SEQ ID NO: 180649
  derived and/or modified sequence opt4 from hemagglutinin__InfluenzaB__AKU40625

SEQ ID NO: 180911 - RNA, 1755 nt, Artificial Sequence
  derived and/or modified sequence opt4 from hemagglutinin__InfluenzaB__AKU40636
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccgccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcaccaagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaaggagggcgaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180912 - RNA, 1755 nt, Artificial Sequence
  derived and/or modified sequence opt4 from hemagglutinin__InfluenzaB__AKU40647
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggagauccccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180913 - RNA, 1755 nt, Artificial Sequence; identical to SEQ ID NO: 180809
  derived and/or modified sequence opt4 from hemagglutinin__InfluenzaB__AKU40658

SEQ ID NO: 180914 - RNA, 1755 nt, Artificial Sequence; identical to SEQ ID NO: 180809
  derived and/or modified sequence opt4 from hemagglutinin__InfluenzaB__AKU40669

SEQ ID NO: 180915 - RNA, 1755 nt, Artificial Sequence; identical to SEQ ID NO: 180809
  derived and/or modified sequence opt4 from hemagglutinin__InfluenzaB__AKU40680

SEQ ID NO: 180916 - RNA, 1755 nt, Artificial Sequence
  derived and/or modified sequence opt4 from hemagglutinin__InfluenzaB__AKU40691
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgaguuccacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180917 - RNA, 1755 nt, Artificial Sequence; identical to SEQ ID NO: 180809
  derived and/or modified sequence opt4 from hemagglutinin__InfluenzaB__AKU40702

SEQ ID NO: 180918 - RNA, 1755 nt, Artificial Sequence; identical to SEQ ID NO: 180809
  derived and/or modified sequence opt4 from hemagglutinin__InfluenzaB__AKU40713

SEQ ID NO: 180919 - RNA, 1755 nt, Artificial Sequence; identical to SEQ ID NO: 180649
  derived and/or modified sequence opt4 from hemagglutinin__InfluenzaB__AKU40724

SEQ ID NO: 180920 - RNA, 1755 nt, Artificial Sequence; identical to SEQ ID NO: 180912
  derived and/or modified sequence opt4 from hemagglutinin__InfluenzaB__AKU40735

SEQ ID NO: 180921 - RNA, 1755 nt, Artificial Sequence; identical to SEQ ID NO: 180809
  derived and/or modified sequence opt4 from hemagglutinin__InfluenzaB__AKU40746

SEQ ID NO: 180922 - RNA, 1755 nt, Artificial Sequence; identical to SEQ ID NO: 180809
  derived and/or modified sequence opt4 from hemagglutinin__InfluenzaB__AKU40757

SEQ ID NO: 180923 - RNA, 1755 nt, Artificial Sequence; identical to SEQ ID NO: 180809
  derived and/or modified sequence opt4 from hemagglutinin__InfluenzaB__AKU40768

SEQ ID NO: 180924 - RNA, 1755 nt, Artificial Sequence; identical to SEQ ID NO: 180809
  derived and/or modified sequence opt4 from hemagglutinin__InfluenzaB__AKU40779

SEQ ID NO: 180925 - RNA, 1755 nt, Artificial Sequence; identical to SEQ ID NO: 180649
  derived and/or modified sequence opt4 from hemagglutinin__InfluenzaB__AKU40790

SEQ ID NO: 180926 - RNA, 1755 nt, Artificial Sequence; identical to SEQ ID NO: 180809
  derived and/or modified sequence opt4 from hemagglutinin__InfluenzaB__AKU40801

SEQ ID NO: 180927 - RNA, 1755 nt, Artificial Sequence
  derived and/or modified sequence opt4 from hemagglutinin__InfluenzaB__AKU40812
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacagccacaccauccugcuguacuacagcaccgccgccagcagccuggccgugacccugaugcuggccaucuucaucguguacauggugagcagagacaacgugagcugcagcaucugccuguga

SEQ ID NO: 180928 - RNA, 1755 nt, Artificial Sequence; identical to SEQ ID NO: 180809
  derived and/or modified sequence opt4 from hemagglutinin__InfluenzaB__AKU40823

SEQ ID NO: 180929 - RNA, 1755 nt, Artificial Sequence; identical to SEQ ID NO: 180809
  derived and/or modified sequence opt4 from hemagglutinin__InfluenzaB__AKU40834

SEQ ID NO: 180930 - RNA, 1755 nt, Artificial Sequence; identical to SEQ ID NO: 180809
  derived and/or modified sequence opt4 from hemagglutinin__InfluenzaB__AKU40845

SEQ ID NO: 180931 - RNA, 1755 nt, Artificial Sequence; identical to SEQ ID NO: 180809
  derived and/or modified sequence opt4 from hemagglutinin__InfluenzaB__AKU40856

SEQ ID NO: 180932 - RNA, 1755 nt, Artificial Sequence; identical to SEQ ID NO: 180809
  derived and/or modified sequence opt4 from hemagglutinin__InfluenzaB__AKU40867

SEQ ID NO: 180933 - RNA, 1755 nt, Artificial Sequence; identical to SEQ ID NO: 180809
  derived and/or modified sequence opt4 from hemagglutinin__InfluenzaB__AKU40878

SEQ ID NO: 180934 - RNA, 1758 nt, Artificial Sequence
  derived and/or modified sequence opt4 from hemagglutinin__InfluenzaB__AKU40889
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaccgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180935 - RNA, 1755 nt, Artificial Sequence; identical to SEQ ID NO: 180809
  derived and/or modified sequence opt4 from hemagglutinin__InfluenzaB__AKU40900

SEQ ID NO: 180936 - RNA, 1755 nt, Artificial Sequence; identical to SEQ ID NO: 180649
  derived and/or modified sequence opt4 from hemagglutinin__InfluenzaB__AKU40911

SEQ ID NO: 180937 - RNA, 1755 nt, Artificial Sequence
  derived and/or modified sequence opt4 from hemagglutinin__InfluenzaB__AKU40922
augaaggccaucaucgugcugcugaugguggugaccagcaacgccgacagaaucugcaccggcaucaccagcagcaacagcccccacguggugaagaccgugacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180938 - RNA, 1755 nt, Artificial Sequence; identical to SEQ ID NO: 180912
  derived and/or modified sequence opt4 from hemagglutinin__InfluenzaB__AKU40933

SEQ ID NO: 180939 - RNA, 1755 nt, Artificial Sequence; identical to SEQ ID NO: 180809
  derived and/or modified sequence opt4 from hemagglutinin__InfluenzaB__AKU40944

SEQ ID NO: 180940 - RNA, 1755 nt, Artificial Sequence; identical to SEQ ID NO: 180809
  derived and/or modified sequence opt4 from hemagglutinin__InfluenzaB__AKU40955

SEQ ID NO: 180941 - RNA, 1755 nt, Artificial Sequence; identical to SEQ ID NO: 180809
  derived and/or modified sequence opt4 from hemagglutinin__InfluenzaB__AKU40966

SEQ ID NO: 180942 - RNA, 1755 nt, Artificial Sequence; identical to SEQ ID NO: 180809
  derived and/or modified sequence opt4 from hemagglutinin__InfluenzaB__AKU40977

SEQ ID NO: 180943 - RNA, 1755 nt, Artificial Sequence; identical to SEQ ID NO: 180809
  derived and/or modified sequence opt4 from hemagglutinin__InfluenzaB__AKU40987

SEQ ID NO: 180944 - RNA, 1755 nt, Artificial Sequence; identical to SEQ ID NO: 180809
  derived and/or modified sequence opt4 from hemagglutinin__InfluenzaB__AKU40998

SEQ ID NO: 180945 - RNA, 1755 nt, Artificial Sequence; identical to SEQ ID NO: 180809
  derived and/or modified sequence opt4 from hemagglutinin__InfluenzaB__AKU41009

SEQ ID NO: 180946 - RNA, 1755 nt, Artificial Sequence; identical to SEQ ID NO: 180809
  derived and/or modified sequence opt4 from hemagglutinin__InfluenzaB__AKU41020

SEQ ID NO: 180947 - RNA, 1755 nt, Artificial Sequence; identical to SEQ ID NO: 180809
  derived and/or modified sequence opt4 from hemagglutinin__InfluenzaB__ALA08485

SEQ ID NO: 180948 - RNA, 1755 nt, Artificial Sequence; identical to SEQ ID NO: 180809
  derived and/or modified sequence opt4 from hemagglutinin__InfluenzaB__ALA08486

SEQ ID NO: 180949 - RNA, 1755 nt, Artificial Sequence; identical to SEQ ID NO: 180809
  derived and/or modified sequence opt4 from hemagglutinin__InfluenzaB__ALA08487

SEQ ID NO: 180950 - RNA, 1755 nt, Artificial Sequence; identical to SEQ ID NO: 180809
  derived and/or modified sequence opt4 from hemagglutinin__InfluenzaB__ALA08564

SEQ ID NO: 180951 - RNA, 1755 nt, Artificial Sequence; identical to SEQ ID NO: 180809
  derived and/or modified sequence opt4 from hemagglutinin__InfluenzaB__ALA08565

SEQ ID NO: 180952 - RNA, 1755 nt, Artificial Sequence; identical to SEQ ID NO: 180809
  derived and/or modified sequence opt4 from hemagglutinin__InfluenzaB__ALA08566

SEQ ID NO: 180953 - RNA, 1755 nt, Artificial Sequence; identical to SEQ ID NO: 180809
  derived and/or modified sequence opt4 from hemagglutinin__InfluenzaB__ALA08567

SEQ ID NO: 180954 - RNA, 1755 nt, Artificial Sequence; identical to SEQ ID NO: 180809
  derived and/or modified sequence opt4 from hemagglutinin__InfluenzaB__ALA08568

SEQ ID NO: 180955 - RNA, 1755 nt, Artificial Sequence; identical to SEQ ID NO: 180809
  derived and/or modified sequence opt4 from hemagglutinin__InfluenzaB__ALA08569

SEQ ID NO: 180956 - RNA, 1758 nt, Artificial Sequence
  derived and/or modified sequence opt4 from hemagglutinin__InfluenzaB__ALA08689
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccccaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180957 - RNA, 1758 nt, Artificial Sequence
  derived and/or modified sequence opt4 from hemagglutinin__InfluenzaB__ALA08690
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacaucaccaacggcaacggcuucuucgccaccauggccugggccgugcagaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacgaccacaccauccugcuguacuacagcaccgccgccagcagccuggccgugacccugaugaucgccaucuucgugguguacauggugagcagagacaacgugagcugcagcaucugccuguga

SEQ ID NO: 180958 - RNA, 1755 nt, Artificial Sequence; identical to SEQ ID NO: 180809
  derived and/or modified sequence opt4 from hemagglutinin__InfluenzaB__ALE31766

SEQ ID NO: 180959 - RNA, 1758 nt, Artificial Sequence
  derived and/or modified sequence opt4 from hemagglutinin__InfluenzaB__ALE31768
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180960 - RNA, 1758 nt, Artificial Sequence
  derived and/or modified sequence opt4 from hemagglutinin__InfluenzaB__ALE31770
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagccugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180961 - RNA, 1755 nt, Artificial Sequence; identical to SEQ ID NO: 180809
  derived and/or modified sequence opt4 from hemagglutinin__InfluenzaB__ALE31772

SEQ ID NO: 180962 - RNA, 1755 nt, Artificial Sequence; identical to SEQ ID NO: 180809
  derived and/or modified sequence opt4 from hemagglutinin__InfluenzaB__ALE31773

SEQ ID NO: 180963 - RNA, 1755 nt, Artificial Sequence
  derived and/or modified sequence opt4 from hemagglutinin__InfluenzaB__ALE31884
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcgugugccuguga

SEQ ID NO: 180964 - RNA, 1755 nt, Artificial Sequence
  derived and/or modified sequence opt4 from hemagglutinin__InfluenzaB__ALE31885
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucgugguguacauggugagcagagacaacgugagcugcagcaucugccuguga

SEQ ID NO: 180965 - RNA, 1755 nt, Artificial Sequence; identical to SEQ ID NO: 180809
  derived and/or modified sequence opt4 from hemagglutinin__InfluenzaB__ALE31886

SEQ ID NO: 180966 - RNA, 1755 nt, Artificial Sequence
  derived and/or modified sequence opt4 from hemagglutinin__InfluenzaB__ALE31887
augaaggccaucaucgugcugcugaugguggugaccagcaacgccgacagaaucugcaccggcaucaccagcagcaacagcccccacguggugaagaccgccacccagggcgagaucaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180967 - RNA, 1755 nt, Artificial Sequence; identical to SEQ ID NO: 180809
  derived and/or modified sequence opt4 from hemagglutinin__InfluenzaB__ALE31982

SEQ ID NO: 180968 - RNA, 1755 nt, Artificial Sequence
  derived and/or modified sequence opt4 from hemagglutinin__InfluenzaB__ALE31983
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggcccuguucaucguguacauggugagcagagacaacgugagcugcagcaucugccuguga

SEQ ID NO: 180969 - RNA, 1755 nt, Artificial Sequence
  derived and/or modified sequence opt4 from hemagglutinin__InfluenzaB__ALE31984
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgaggaggaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180970 - RNA, 1755 nt, Artificial Sequence; identical to SEQ ID NO: 180809
  derived and/or modified sequence opt4 from hemagglutinin__InfluenzaB__ALE31985

SEQ ID NO: 180971 - RNA, 1758 nt, Artificial Sequence
  derived and/or modified sequence opt4 from hemagglutinin__InfluenzaB__ALE31986
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugaucgacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccgugggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180972 - RNA, 1755 nt, Artificial Sequence
  derived and/or modified sequence opt4 from hemagglutinin__InfluenzaB__ALE31988
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180973 - RNA, 1758 nt, Artificial Sequence; identical to SEQ ID NO: 180971
  derived and/or modified sequence opt4 from hemagglutinin__InfluenzaB__ALE31989

SEQ ID NO: 180974 - RNA, 1758 nt, Artificial Sequence; identical to SEQ ID NO: 180971
  derived and/or modified sequence opt4 from hemagglutinin__InfluenzaB__ALE31990

SEQ ID NO: 180975 - RNA, 1755 nt, Artificial Sequence; identical to SEQ ID NO: 180809
  derived and/or modified sequence opt4 from hemagglutinin__InfluenzaB__ALE31991

SEQ ID NO: 180976 - RNA, 1758 nt, Artificial Sequence
  derived and/or modified sequence opt4 from hemagglutinin__InfluenzaB__ALE31992
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacgugagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagagagaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180977 - RNA, 1758 nt, Artificial Sequence; identical to SEQ ID NO: 180385
  derived and/or modified sequence opt4 from hemagglutinin__InfluenzaB__ALE31993

SEQ ID NO: 180978 - RNA, 1758 nt, Artificial Sequence
  derived and/or modified sequence opt4 from hemagglutinin__InfluenzaB__ALE31994
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacgugagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugagaaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180979 - RNA, 1755 nt, Artificial Sequence; identical to SEQ ID NO: 180968
  derived and/or modified sequence opt4 from hemagglutinin__InfluenzaB__ALN39719

SEQ ID NO: 180980 - RNA, 1755 nt, Artificial Sequence; identical to SEQ ID NO: 180809
  derived and/or modified sequence opt4 from hemagglutinin__InfluenzaB__ALN39720

SEQ ID NO: 180981 - RNA, 1755 nt, Artificial Sequence; identical to SEQ ID NO: 180809
  derived and/or modified sequence opt4 from hemagglutinin__InfluenzaB__ALN39721

SEQ ID NO: 180982 - RNA, 1755 nt, Artificial Sequence; identical to SEQ ID NO: 180809
  derived and/or modified sequence opt4 from hemagglutinin__InfluenzaB__ALN39723

SEQ ID NO: 180983 - RNA, 1755 nt, Artificial Sequence; identical to SEQ ID NO: 180809
  derived and/or modified sequence opt4 from hemagglutinin__InfluenzaB__ALN39724

SEQ ID NO: 180984 - RNA, 1755 nt, Artificial Sequence; identical to SEQ ID NO: 180972
  derived and/or modified sequence opt4 from hemagglutinin__InfluenzaB__ALN39725

SEQ ID NO: 180985 - RNA, 1755 nt, Artificial Sequence
  derived and/or modified sequence opt4 from hemagglutinin__InfluenzaB__ALN39726
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccgacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180986 - RNA, 1755 nt, Artificial Sequence; identical to SEQ ID NO: 180972
  derived and/or modified sequence opt4 from hemagglutinin__InfluenzaB__ALN39727

SEQ ID NO: 180987 - RNA, 1755 nt, Artificial Sequence; identical to SEQ ID NO: 180809
  derived and/or modified sequence opt4 from hemagglutinin__InfluenzaB__ALN39728

SEQ ID NO: 180988 - RNA, 1755 nt, Artificial Sequence; identical to SEQ ID NO: 180809
  derived and/or modified sequence opt4 from hemagglutinin__InfluenzaB__ALN39729

SEQ ID NO: 180989 - RNA, 1758 nt, Artificial Sequence
  derived and/or modified sequence opt4 from hemagglutinin__InfluenzaB__ALN39730
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacgugagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucuuccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180990 - RNA, 1755 nt, Artificial Sequence; identical to SEQ ID NO: 180809
  derived and/or modified sequence opt4 from hemagglutinin__InfluenzaB__ALN39732

SEQ ID NO: 180991 - RNA, 1755 nt, Artificial Sequence
  derived and/or modified sequence opt4 from hemagglutinin__InfluenzaB__ALN39733
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacagaugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180992 - RNA, 1755 nt, Artificial Sequence
  derived and/or modified sequence opt4 from hemagglutinin__InfluenzaB__ALN39751
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugguggccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggcccuguucaucguguacauggugagcagagacaacgugagcugcagcaucugccuguga

SEQ ID NO: 180993 - RNA, 1755 nt, Artificial Sequence; identical to SEQ ID NO: 180968
  derived and/or modified sequence opt4 from hemagglutinin__InfluenzaB__ALN39752

SEQ ID NO: 180994 - RNA, 1755 nt, Artificial Sequence; identical to SEQ ID NO: 180809
  derived and/or modified sequence opt4 from hemagglutinin__InfluenzaB__ALN39753

SEQ ID NO: 180995 - RNA, 1758 nt, Artificial Sequence
  derived and/or modified sequence opt4 from hemagglutinin__InfluenzaB__ALN39754
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacgugagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180996 - RNA, 1758 nt, Artificial Sequence
  derived and/or modified sequence opt4 from hemagglutinin__InfluenzaB__ALN39755
augaaggccaucaucgugcugcugcugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacgugagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 180997 - RNA, 1755 nt, Artificial Sequence
  derived and/or modified sequence opt4 from hemagglutinin__InfluenzaB__ALN39756
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgugggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 180998 - RNA, 1758 nt, Artificial Sequence; identical to SEQ ID NO: 180995
  derived and/or modified sequence opt4 from hemagglutinin__InfluenzaB__ALN39757

SEQ ID NO: 180999 - RNA, 1755 nt, Artificial Sequence; identical to SEQ ID NO: 180809
  derived and/or modified sequence opt4 from hemagglutinin__InfluenzaB__ALN39758

SEQ ID NO: 181000 - RNA, 1755 nt, Artificial Sequence
  derived and/or modified sequence opt4 from hemagglutinin__InfluenzaB__ALN39759
augaagaccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181001 - RNA, 1758 nt, Artificial Sequence; identical to SEQ ID NO: 180959
  derived and/or modified sequence opt4 from hemagglutinin__InfluenzaB__ALN39760

SEQ ID NO: 181002 - RNA, 1755 nt, Artificial Sequence; identical to SEQ ID NO: 180809
  derived and/or modified sequence opt4 from hemagglutinin__InfluenzaB__ALN39761

SEQ ID NO: 181003 - RNA, 1755 nt, Artificial Sequence; identical to SEQ ID NO: 180809
  derived and/or modified sequence opt4 from hemagglutinin__InfluenzaB__ALN39762

SEQ ID NO: 181004 - RNA, 1755 nt, Artificial Sequence; identical to SEQ ID NO: 180809
  derived and/or modified sequence opt4 from hemagglutinin__InfluenzaB__ALN39763

SEQ ID NO: 181005 - RNA, 1758 nt, Artificial Sequence; identical to SEQ ID NO: 180995
  derived and/or modified sequence opt4 from hemagglutinin__InfluenzaB__ALN39764

SEQ ID NO: 181006 - RNA, 1755 nt, Artificial Sequence
  derived and/or modified sequence opt4 from hemagglutinin__InfluenzaB__ALN39765
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaacaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggcccuguucaucguguacauggugagcagagacaacgugagcugcagcaucugccuguga

SEQ ID NO: 181007 - RNA, 1755 nt, Artificial Sequence; identical to SEQ ID NO: 180972
  derived and/or modified sequence opt4 from hemagglutinin__InfluenzaB__ALN39766

SEQ ID NO: 181008 - RNA, 1755 nt, Artificial Sequence; identical to SEQ ID NO: 180809
  derived and/or modified sequence opt4 from hemagglutinin__InfluenzaB__ALN39767

SEQ ID NO: 181009 - RNA, 1755 nt, Artificial Sequence; identical to SEQ ID NO: 180972
  derived and/or modified sequence opt4 from hemagglutinin__InfluenzaB__ALN39768

SEQ ID NO: 181010 - RNA, 1755 nt, Artificial Sequence
  derived and/or modified sequence opt4 from hemagglutinin__InfluenzaB__ALN39769
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacggcagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181011 - RNA, 1755 nt, Artificial Sequence; identical to SEQ ID NO: 180968
  derived and/or modified sequence opt4 from hemagglutinin__InfluenzaB__ALN39770

SEQ ID NO: 181012 - RNA, 1755 nt, Artificial Sequence; identical to SEQ ID NO: 180968
  derived and/or modified sequence opt4 from hemagglutinin__InfluenzaB__ALN39771

SEQ ID NO: 181013 - RNA, 1755 nt, Artificial Sequence; identical to SEQ ID NO: 180809
  derived and/or modified sequence opt4 from hemagglutinin__InfluenzaB__ALN39773

SEQ ID NO: 181014 - RNA, 1755 nt, Artificial Sequence; identical to SEQ ID NO: 180809
  derived and/or modified sequence opt4 from hemagglutinin__InfluenzaB__ALN39774

SEQ ID NO: 181015 - RNA, 1758 nt, Artificial Sequence
  derived and/or modified sequence opt4 from hemagglutinin__InfluenzaB__ALN39775
augcaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugaucgacuacauggugcagaagagcggcaagaccggcaccaucaccuaccagagaggcauccugcugccccagaagguguggugcgugagcggcagaagcaaggugaucaagggcagccugccccugaucggcgaggccgacugccugcacgagaaguacggcggccugaacaagagcaagcccuacuacaccggcgagcacgccaaggccgugggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181016 - RNA, 1755 nt, Artificial Sequence
  derived and/or modified sequence opt4 from hemagglutinin__InfluenzaB__ALN39776
augaaggccaucaucauccugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181017 - RNA, 1755 nt, Artificial Sequence; identical to SEQ ID NO: 180972
  derived and/or modified sequence opt4 from hemagglutinin__InfluenzaB__ALN39778

SEQ ID NO: 181018 - RNA, 1758 nt, Artificial Sequence; identical to SEQ ID NO: 180995
  derived and/or modified sequence opt4 from hemagglutinin__InfluenzaB__ALN39779

SEQ ID NO: 181019 - RNA, 1755 nt, Artificial Sequence; identical to SEQ ID NO: 180809
  derived and/or modified sequence opt4 from hemagglutinin__InfluenzaB__ALN39780

SEQ ID NO: 181020 - RNA, 1758 nt, Artificial Sequence; identical to SEQ ID NO: 180995
  derived and/or modified sequence opt4 from hemagglutinin__InfluenzaB__ALN39781

SEQ ID NO: 181021 - RNA, 1758 nt, Artificial Sequence; identical to SEQ ID NO: 180959
  derived and/or modified sequence opt4 from hemagglutinin__InfluenzaB__ALN39782

SEQ ID NO: 181022 - RNA, 1755 nt, Artificial Sequence
  derived and/or modified sequence opt4 from hemagglutinin__InfluenzaB__ALN39783
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaaccugcagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181023 - RNA, 1758 nt, Artificial Sequence; identical to SEQ ID NO: 180971
  derived and/or modified sequence opt4 from hemagglutinin__InfluenzaB__ALN39784

SEQ ID NO: 181024 - RNA, 1758 nt, Artificial Sequence; identical to SEQ ID NO: 180995
  derived and/or modified sequence opt4 from hemagglutinin__InfluenzaB__ALN39785

SEQ ID NO: 181025 - RNA, 1755 nt, Artificial Sequence; identical to SEQ ID NO: 180809
  derived and/or modified sequence opt4 from hemagglutinin__InfluenzaB__ALN39786

SEQ ID NO: 181026 - RNA, 1758 nt, Artificial Sequence; identical to SEQ ID NO: 180995
  derived and/or modified sequence opt4 from hemagglutinin__InfluenzaB__ALN39787

SEQ ID NO: 181027 - RNA, 1758 nt, Artificial Sequence; identical to SEQ ID NO: 180995
  derived and/or modified sequence opt4 from hemagglutinin__InfluenzaB__ALN39788

SEQ ID NO: 181028 - RNA, 1755 nt, Artificial Sequence
  derived and/or modified sequence opt4 from hemagglutinin__InfluenzaB__ALN39790
augaaggccaucaucgugcugcugaugguggugaccagcgacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagagauucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181029 - RNA, 1755 nt, Artificial Sequence
  derived and/or modified sequence opt4 from hemagglutinin__InfluenzaB__ALN39791
augaaggccaucaucgugcugcugaugguggugaugagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181030 - RNA, 1758 nt, Artificial Sequence; identical to SEQ ID NO: 180995
  derived and/or modified sequence opt4 from hemagglutinin__InfluenzaB__ALN39792

SEQ ID NO: 181031 - RNA, 1758 nt, Artificial Sequence; identical to SEQ ID NO: 180995
  derived and/or modified sequence opt4 from hemagglutinin__InfluenzaB__ALN39793

SEQ ID NO: 181032 - RNA, 1755 nt, Artificial Sequence
  derived and/or modified sequence opt4 from hemagglutinin__InfluenzaB__ALN39794
augaaggccaucaucauccugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccgacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181033 - RNA, 1755 nt, Artificial Sequence; identical to SEQ ID NO: 180972
  derived and/or modified sequence opt4 from hemagglutinin__InfluenzaB__ALN39795

SEQ ID NO: 181034 - RNA, 1758 nt, Artificial Sequence
  derived and/or modified sequence opt4 from hemagglutinin__InfluenzaB__ALN39796
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgccaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181035 - RNA, 1755 nt, Artificial Sequence; identical to SEQ ID NO: 180972
  derived and/or modified sequence opt4 from hemagglutinin__InfluenzaB__ALN39797

SEQ ID NO: 181036 - RNA, 1755 nt, Artificial Sequence
  derived and/or modified sequence opt4 from hemagglutinin__InfluenzaB__ALN39798
augaaggccaucaucgugcugcugaugguggugaccagcaacgccgacagaaucugcaccggcaucaccagcagcagcagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181037 - RNA, 1755 nt, Artificial Sequence; identical to SEQ ID NO: 180809
  derived and/or modified sequence opt4 from hemagglutinin__InfluenzaB__ALN39799

SEQ ID NO: 181038 - RNA, 1755 nt, Artificial Sequence
  derived and/or modified sequence opt4 from hemagglutinin__InfluenzaB__ALN39800
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagaagaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181039 - RNA, 1755 nt, Artificial Sequence; identical to SEQ ID NO: 181029
  derived and/or modified sequence opt4 from hemagglutinin__InfluenzaB__ALN39801

SEQ ID NO: 181040 - RNA, 1755 nt, Artificial Sequence; identical to SEQ ID NO: 180972
  derived and/or modified sequence opt4 from hemagglutinin__InfluenzaB__ALN39802

SEQ ID NO: 181041 - RNA, 1755 nt, Artificial Sequence; identical to SEQ ID NO: 181029
  derived and/or modified sequence opt4 from hemagglutinin__InfluenzaB__ALN39803

SEQ ID NO: 181042 - RNA, 1755 nt, Artificial Sequence; identical to SEQ ID NO: 180968
  derived and/or modified sequence opt4 from hemagglutinin__InfluenzaB__ALN39804

SEQ ID NO: 181043 - RNA, 1758 nt, Artificial Sequence; identical to SEQ ID NO: 180995
  derived and/or modified sequence opt4 from hemagglutinin__InfluenzaB__ALN39805

SEQ ID NO: 181044 - RNA, 1758 nt, Artificial Sequence; identical to SEQ ID NO: 179509
  derived and/or modified sequence opt4 from hemagglutinin__InfluenzaB__ACN29380

SEQ ID NO: 181045 - RNA, 1758 nt, Artificial Sequence; identical to SEQ ID NO: 179841
  derived and/or modified sequence opt4 from hemagglutinin__InfluenzaB__EPI498048

SEQ ID NO: 181046 - RNA, 1758 nt, Artificial Sequence
  derived and/or modified sequence opt4 from hemagglutinin__InfluenzaB__ANC28539
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181047 - RNA, 1758 nt, Artificial Sequence
  derived and/or modified sequence opt4 from hemagglutinin__InfluenzaB__EPI827073
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggccugcacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181048 - RNA, 1758 nt, Artificial Sequence; identical to SEQ ID NO: 179267
  derived and/or modified sequence opt4 from hemagglutinin__InfluenzaB__EPI244699

SEQ ID NO: 181049 - RNA, 1758 nt, Artificial Sequence; identical to SEQ ID NO: 179260
  derived and/or modified sequence opt4 from hemagglutinin__InfluenzaB__EPI244702

SEQ ID NO: 181050 - RNA, 1755 nt, Artificial Sequence; identical to SEQ ID NO: 180649
  derived and/or modified sequence opt4 from hemagglutinin__InfluenzaB__EPI540671

SEQ ID NO: 181051 - RNA, 1755 nt, Artificial Sequence
  derived and/or modified sequence opt4 from hemagglutinin__InfluenzaB__EPI573303
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacgacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181052 - RNA, 1755 nt, Artificial Sequence
  derived and/or modified sequence opt4 from hemagglutinin__InfluenzaB__EPI829466
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacgacaagacccagaugaagagccuguacggcgacagcaacccccagaaguucaccagcagcgccaacggcgugaccacccacuacgugagccagaucggcgacuuccccgaccagaccgaggacgagggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181053 - RNA, 1755 nt, Artificial Sequence
  derived and/or modified sequence opt4 from hemagglutinin__InfluenzaB__EPI684429
augaaggccaucaucgugcugcugaugguggugaugagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgugagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181054 - RNA, 1758 nt, Artificial Sequence; identical to SEQ ID NO: 179272
  derived and/or modified sequence opt4 from hemagglutinin__InfluenzaB__AFH58447

SEQ ID NO: 181055 - RNA, 1758 nt, Artificial Sequence
  derived and/or modified sequence opt4 from hemagglutinin__InfluenzaB__EPI173279
augaaggccaucaucgugauccugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181056 - RNA, 1758 nt, Artificial Sequence; identical to SEQ ID NO: 179841
  derived and/or modified sequence opt4 from hemagglutinin__InfluenzaB__EPI163726

SEQ ID NO: 181057 - RNA, 1758 nt, Artificial Sequence; identical to SEQ ID NO: 180995
  derived and/or modified sequence opt4 from hemagglutinin__InfluenzaB__EPI636340

SEQ ID NO: 181058 - RNA, 1758 nt, Artificial Sequence
  derived and/or modified sequence opt4 from hemagglutinin__InfluenzaB__EPI645995
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacgugagacugagcacccacaacgugaucaacgccgaggacgcccccggcggccccuacaagaucggcaccagcggcagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacgacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181059 - RNA, 1755 nt, Artificial Sequence; identical to SEQ ID NO: 180649
  derived and/or modified sequence opt4 from hemagglutinin__InfluenzaB__EPI539769

SEQ ID NO: 181060 - RNA, 1755 nt, Artificial Sequence; identical to SEQ ID NO: 181051
  derived and/or modified sequence opt4 from hemagglutinin__InfluenzaB__EPI551249

SEQ ID NO: 181061 - RNA, 1755 nt, Artificial Sequence
  derived and/or modified sequence opt4 from hemagglutinin__InfluenzaB__EPI544259
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagaaccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181062 - RNA, 1755 nt, Artificial Sequence
  derived and/or modified sequence opt4 from hemagglutinin__InfluenzaB__EPI592699
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagauccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181063 - RNA, 1755 nt, Artificial Sequence; identical to SEQ ID NO: 180972
  derived and/or modified sequence opt4 from hemagglutinin__InfluenzaB__EPI592707

SEQ ID NO: 181064 - RNA, 1755 nt, Artificial Sequence
  derived and/or modified sequence opt4 from hemagglutinin__InfluenzaB__EPI693094
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcgagagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagauccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181065 - RNA, 1758 nt, Artificial Sequence; identical to SEQ ID NO: 180995
  derived and/or modified sequence opt4 from hemagglutinin__InfluenzaB__EPI678796

SEQ ID NO: 181066 - RNA, 1758 nt, Artificial Sequence
  derived and/or modified sequence opt4 from hemagglutinin__InfluenzaB__EPI721064
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacgugagacugagcacccacaacgugaucaacgccgaggacgcccccggcggccccuacaagaucggcaccagcagaagcugccccaacaucaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181067 - RNA, 1758 nt, Artificial Sequence; identical to SEQ ID NO: 179276
  derived and/or modified sequence opt4 from hemagglutinin__InfluenzaB__EPI328904

SEQ ID NO: 181068 - RNA, 1755 nt, Artificial Sequence
  derived and/or modified sequence opt4 from hemagglutinin__InfluenzaB__EPI543191
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaagaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181069 - RNA, 1755 nt, Artificial Sequence; identical to SEQ ID NO: 180649
  derived and/or modified sequence opt4 from hemagglutinin__InfluenzaB__EPI500359

SEQ ID NO: 181070 - RNA, 1755 nt, Artificial Sequence
  derived and/or modified sequence opt4 from hemagglutinin__InfluenzaB__EPI543185
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccagaccguggaggugcccuacaucugcaccgagggcgaggaccagaucaccguguggggcuuccacagcgacaacaagaaccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181071 - RNA, 1755 nt, Artificial Sequence; identical to SEQ ID NO: 180809
  derived and/or modified sequence opt4 from hemagglutinin__InfluenzaB__EPI536447

SEQ ID NO: 181072 - RNA, 1755 nt, Artificial Sequence; identical to SEQ ID NO: 179278
  derived and/or modified sequence opt4 from hemagglutinin__InfluenzaB__NP_056660

SEQ ID NO: 181073 - RNA, 1755 nt, Artificial Sequence
  derived and/or modified sequence opt4 from hemagglutinin__InfluenzaB__ABG85167
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccagaagccacuucgccaaccugaagggcacccagaccagaggcaagcugugccccaacugcuucaacugcaccgaccuggacguggcccugggcagacccaagugcaugggcaacauccccagcgccaaggugagcauccugcacgaggugaagcccgugaccagcggcugcuuccccaucaugcacgacagaaccaagaucagacagcugcccaaccugcugagaggcuacgagaacaucagacugagcaccagcaacgugaucaacgccgagaccgcccccggcggccccuacaaggugggcaccagcggcagcugccccaacguggccaacagaaacggcuucuucaacaccauggccugggugauccccaaggacaacaacaagaccgccaucaaccccgugaccguggaggugcccuacaucugcagcgagggcgaggaccagaucaccguguggggcuuccacagcgacgacaagacccagauggagagacuguacggcgacagcaacccccagaaguucaccagcagcgccaacggcgugaccacccacuacgugagccagaucggcggcuuccccaaccagaccgaggacgagggccugaagcagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccaugaacggccugcacgacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgacuucagccugcccaccuucgacagccugaacaucaccgccgccagccugaacgacgacgaccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 181074 - RNA, 1755 nt, Artificial Sequence
  derived and/or modified sequence opt4 from hemagglutinin__InfluenzaB__EPI376346
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcgccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181075 - RNA, 1755 nt, Artificial Sequence; identical to SEQ ID NO: 179374
  derived and/or modified sequence opt4 from hemagglutinin__InfluenzaB__EPI368425

SEQ ID NO: 181076 - RNA, 1755 nt, Artificial Sequence; identical to SEQ ID NO: 179340
  derived and/or modified sequence opt4 from hemagglutinin__InfluenzaB__ACH53430

SEQ ID NO: 181077 - RNA, 1758 nt, Artificial Sequence; identical to SEQ ID NO: 179165
  derived and/or modified sequence opt4 from hemagglutinin__InfluenzaB__EPI331151

SEQ ID NO: 181078 - RNA, 1758 nt, Artificial Sequence
  derived and/or modified sequence opt4 from hemagglutinin__InfluenzaB__EPI356777
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacgacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181079 - RNA, 1752 nt, Artificial Sequence; identical to SEQ ID NO: 178947
  derived and/or modified sequence opt4 from hemagglutinin__InfluenzaB__CY018349

SEQ ID NO: 181080 - RNA, 1752 nt, Artificial Sequence
  derived and/or modified sequence opt4 from hemagglutinin__InfluenzaB__AY581945
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccuggccagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagagagcccccggcggccccuacagacugggcaccagcggcagcugccccaacgugaccagcagagacggcuucuucgccaccauggccugggccgugcccagagacaacaagaccgccaccaacccccugaccguggaggugcccuacaucugcaccaagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 181081 - RNA, 1755 nt, Artificial Sequence; identical to SEQ ID NO: 180828
  derived and/or modified sequence opt4 from hemagglutinin__InfluenzaB__EPI541351

SEQ ID NO: 181082 - RNA, 1755 nt, Artificial Sequence
  derived and/or modified sequence opt4 from hemagglutinin__InfluenzaB__EPI541760
augaaggccgugaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181083 - RNA, 1758 nt, Artificial Sequence; identical to SEQ ID NO: 179407
  derived and/or modified sequence opt4 from hemagglutinin__InfluenzaB__EPI477397

SEQ ID NO: 181084 - RNA, 1758 nt, Artificial Sequence
  derived and/or modified sequence opt4 from hemagglutinin__InfluenzaB__EPI492571
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaucgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181085 - RNA, 1758 nt, Artificial Sequence
  derived and/or modified sequence opt4 from hemagglutinin__InfluenzaB__EPI498340
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacaccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaucgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181086 - RNA, 1758 nt, Artificial Sequence
  derived and/or modified sequence opt4 from hemagglutinin__InfluenzaB__EPI516490
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaagauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgaggacgcccccggcggccccuacaagaucggcaccagcggcagcugccccaacgugaccaacggcaacggcuucuucgccaccauggccugggccgugcccaagaacgacaagaacaagaccgccaccaacccccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 181087 - RNA, 1755 nt, Artificial Sequence; identical to SEQ ID NO: 180649
  derived and/or modified sequence opt4 from hemagglutinin__InfluenzaB__EPI538119

SEQ ID NO: 181088 - RNA, 1755 nt, Artificial Sequence; identical to SEQ ID NO: 181068
  derived and/or modified sequence opt4 from hemagglutinin__InfluenzaB__EPI538125

SEQ ID NO: 181089 - RNA, 1755 nt, Artificial Sequence
  derived and/or modified sequence opt4 from hemagglutinin__InfluenzaB__EPI556422
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaucaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181090 - RNA, 1755 nt, Artificial Sequence
  derived and/or modified sequence opt4 from hemagglutinin__InfluenzaB__EPI614608
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccaucaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacgagaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181091 - RNA, 1755 nt, Artificial Sequence
  derived and/or modified sequence opt4 from hemagglutinin__InfluenzaB__EPI614610
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacgagaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgaggaguacggcggccugaacaagagcaagcccuacuacaccggcaagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181092 - RNA, 1758 nt, Artificial Sequence
  derived and/or modified sequence opt4 from hemagglutinin__InfluenzaB__AAA43697
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccuggccagacccaagugcaugggcaccauccccagcgccaaggccagcauccugcacgaggugaagcccgugaccagcggcugcuuccccaucaugcacgacagaaccaagaucagacagcugcccaaccugcugagaggcuacgagcacaucagacugagcacccacaacgugaucaacgccgagaccgcccccggcggccccuacaaggugggcaccagcggcagcugccccaacgugaccaacggcaacggcuucuucgccaccauggccugggccgugcccaagaacgacaacaacaagaccgccaccaacccccugaccguggaggugcccuacaucugcaccgagggcgaggaccagaucaccguguggggcuuccacagcgacagcgagacccagauggugaagcuguacggcgacagcaagccccagaaguucaccagcagcgccaacggcgugaccacccacuacgugagccagaucggcggcuuccccaaccaggccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 181093 - RNA, 1755 nt, Artificial Sequence
  derived and/or modified sequence opt4 from hemagglutinin__InfluenzaB__EPI271545
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagacccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181094 - RNA, 1755 nt, Artificial Sequence
  derived and/or modified sequence opt4 from hemagglutinin__InfluenzaB__AGB08329
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagaucggcuucuucgccaccauggccugggccgugcccaaggacaacuacaagaacgccaccaacccccugaccguggaggugcccuacaucugcaccgagggcgaggaccagaucaccguguggggcuuccacagcgacaacaagauccagaugaagagccuguacggcgacagcaacccccagaaguucaccagcagcgccaacggcgugaccacccacuacgugagccagaucggcgacuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 181095 - RNA, 1755 nt, Artificial Sequence; identical to SEQ ID NO: 179275
  derived and/or modified sequence opt4 from hemagglutinin__InfluenzaB__EPI294880

SEQ ID NO: 181096 - RNA, 1752 nt, Artificial Sequence; identical to SEQ ID NO: 178986
  derived and/or modified sequence opt4 from hemagglutinin__InfluenzaB__CY018765

SEQ ID NO: 181097 - RNA, 1401 nt, Artificial Sequence
  derived and/or modified sequence opt4 from neuraminidase_glycoprotein__InfluenzaB__AAN39743
augcugcccagcaccauccagacccugacccuguuccugaccagcggcggcgugcugcugagccuguacgugagcgcccugcugagcuaccugcuguacagcgacauccugcugaaguucagccccaccaaggugaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcauccacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcagaugcagauuccugaagaucagagagggcagaaucaucaaggagaucuuccccaccggcagaguggagcacaccgaggagugcaccugcggcuucgccagcaacaagaccaucgagugcgugugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcaacggcggcaucaagggcggcuucgugcaccagagaauggccagcagaaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181098 - RNA, 1401 nt, Artificial Sequence
  derived and/or modified sequence opt4 from neuraminidase_glycoprotein__InfluenzaB__AAN39747
augcugcccagcaccauccagacccugauccuguuccugaccagcggcggcgugcugcugagccuguacgugagcgcccugcugagcuaccugcuguacagcgacauccugcugaaguucagccccaccaagaucaucgcccccaccaugagccuggacugcgccaacgccagcaacgugcaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcaucgaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181099 - RNA, 1401 nt, Artificial Sequence
  derived and/or modified sequence opt4 from neuraminidase_glycoprotein__InfluenzaB__AAN39749
augcugcccagcaccauccagacccugacccuguuccugaccagcggcggcgugcugcugagccuguacgugagcgcccugcugagcuaccugcuguacagcgacauccugcugaaguucagccccaccaaggugaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcagaugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcaacggcggcaucaagggcggcuucgugcaccagagaauggccagcagaaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181100 - RNA, 1401 nt, Artificial Sequence
  derived and/or modified sequence opt4 from neuraminidase_glycoprotein__InfluenzaB__AAN39751
augcugcccagcaccauccagacccugacccuguuccugaccagcggcggcgugcugcugagccuguacgugagcgcccugcugagcuaccugcuguacagcgacauccugcugaaguucagccccaccaaggugaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcagaugcagauuccugaagaucagagagggcagaauccugaaggagaucuuccccaccggcagaguggagcacaccgaggagugcaccugcggcuucgccagcaacaagaccaucgagugcgccugcagagacaacagcuacaccgccaagagacccuucgugcagcugaacguggagaccgacaccgccgagaucagacugaugugcaccgagaccuaccuggacacccccagacccgacgacggcagcaucaccggccccugcgagagcaacggcgacaagggcaacggcggcaucaagggcggcuucgugcaccagagaauggccagcagaaucggcagaugguacagcagaaccaugagcaagaccaagagaaugggcauggaccuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181101 - RNA, 1401 nt, Artificial Sequence
  derived and/or modified sequence opt4 from neuraminidase_glycoprotein__InfluenzaB__AAN39753
augcugcccagcaccauccagacccugacccuguuccugaccagcggcggcgugcugcugagccuguacgugagcgcccugcugagcuaccugcuguacagcgacauccugcugaaguucagccccaccaaggugaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcgaguacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcagaugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcaacggcggcaucaagggcggcuucgugcaccagagaauggccagcagaaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181102 - RNA, 1401 nt, Artificial Sequence
  derived and/or modified sequence opt4 from neuraminidase_glycoprotein__InfluenzaB__AAN39759
augcugcccagcaccauccagacccugacccuguuccugaccagcggcggcgugcugcugagccuguacgugagcgccagccugagcuaccugcuguacagcgacauccugcugaagcugagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccaagagaaugggcaugggccuguacgugaaguacgacggcgaccccuggaccgacagcgacgcccuggcccugagcggcgugauggugagcaucgaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181103 - RNA, 1401 nt, Artificial Sequence
  derived and/or modified sequence opt4 from neuraminidase_glycoprotein__InfluenzaB__AAN39761
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181104 - RNA, 1401 nt, Artificial Sequence
  derived and/or modified sequence opt4 from neuraminidase_glycoprotein__InfluenzaB__AAN39769
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaccagccuggacagcgccaacgccagcaacuuccaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181105 - RNA, 1401 nt, Artificial Sequence
  derived and/or modified sequence opt4 from neuraminidase_glycoprotein__InfluenzaB__AAN39771
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaccagccuggacagcgccaacgccagcaacuuccaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucgugaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggaccccagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccaucaccggcguggacauggcccuguga

SEQ ID NO: 181106 - RNA, 1401 nt, Artificial Sequence
  derived and/or modified sequence opt4 from neuraminidase_glycoprotein__InfluenzaB__AAN39773
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaccagccuggacagcgccaacgccagcaacuuccaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaacuucggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucgugaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccaucaccggcguggacauggcccuguga

SEQ ID NO: 181107 - RNA, 1401 nt, Artificial Sequence
  derived and/or modified sequence opt4 from neuraminidase_glycoprotein__InfluenzaB__AAN39775
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaccagccuggacagcgccaacgccagcaacuuccaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcaaggaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181108 - RNA, 1401 nt, Artificial Sequence
  derived and/or modified sequence opt4 from neuraminidase_glycoprotein__InfluenzaB__AAN39777
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugccccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181109 - RNA, 1401 nt, Artificial Sequence; identical to SEQ ID NO: 181104
  derived and/or modified sequence opt4 from neuraminidase_glycoprotein__InfluenzaB__AAN39779

SEQ ID NO: 181110 - RNA, 1401 nt, Artificial Sequence
  derived and/or modified sequence opt4 from neuraminidase_glycoprotein__InfluenzaB__AAN39781
augcugcccagcaccauccagacccugacccuguuccugaccagcggcggcgugcugcugagccuguacgugagcgccagccugagcuaccugcuguacagcgacauccugcugaaguucagcagcaccgagaucaccgcccccaccaugccccugaacugcgccaacgccagcaacgugcaggccgugaaccacagcgccaccaagggcgugacccugccccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcgugagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaacaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181111 - RNA, 1401 nt, Artificial Sequence
  derived and/or modified sequence opt4 from neuraminidase_glycoprotein__InfluenzaB__AAN39783
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181112 - RNA, 1401 nt, Artificial Sequence
  derived and/or modified sequence opt4 from neuraminidase_glycoprotein__InfluenzaB__AAN39785
augcugcccagcaccauccagacccugacccuguuccugaccagcggcggcgugcugcugagccuguacgugagcgcccugcugagcuaccugcuguacagcgacauccugcugaaguucagccccaccaaggugaucgcccccaccaugagccuggacuacgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcagaugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaaugaccagcagaaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181113 - RNA, 1401 nt, Artificial Sequence
  derived and/or modified sequence opt4 from neuraminidase_glycoprotein__InfluenzaB__AAN39787
augcugcccagcaccauccagacccugacccuguuccugaccagcggcggcgugcugcugagccuguacgugagcgcccugcugagcuaccugcuguacagcgacauccugcugaaguucagccccaccaaggugaucgcccccaccaugagccuggacuacgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcagaugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcaacggcggcaucaagggcggcuucgugcaccagagaauggccagcagaaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181114 - RNA, 1401 nt, Artificial Sequence
  derived and/or modified sequence opt4 from neuraminidase_glycoprotein__InfluenzaB__AAN39795
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaccagcaagugcagauuccugaagaucagagagggcagaaucaucaaggagaucuuccccaccggcagaguggagcacaccgaggagugcaccugcggcuucgccagcaacaagaccaucgagugcgccugcagagacaacaacuacaccgccaagagacccuucgugaagcugaacguggagaccgacgccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181115 - RNA, 1401 nt, Artificial Sequence; identical to SEQ ID NO: 181099
  derived and/or modified sequence opt4 from neuraminidase_glycoprotein__InfluenzaB__AAN39797

SEQ ID NO: 181116 - RNA, 1401 nt, Artificial Sequence
  derived and/or modified sequence opt4 from neuraminidase_glycoprotein__InfluenzaB__AAN39799
augcugcccagcaccauccagacccugacccuguuccugaccagcggcggcgugcugcugagccuguacgugagcgcccugcugagcuaccugcuguacagcgacgugcugcugaaguucagccccaccaagaucaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucgaguacggcgaggccuacaccgacaccuaccacagcuacgccuacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181117 - RNA, 1401 nt, Artificial Sequence
  derived and/or modified sequence opt4 from neuraminidase_glycoprotein__InfluenzaB__AAN39801
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgcccaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181118 - RNA, 1401 nt, Artificial Sequence
  derived and/or modified sequence opt4 from neuraminidase_glycoprotein__InfluenzaB__AAN39803
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaaggugccccuggacugcgccaacgccagcaacgugcaggccgugaacagaagcgccaccaagggcaugacccugcugcugagcgagcccgaguggaccuaccccagacugagcugccagggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggccuggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccccagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181119 - RNA, 1401 nt, Artificial Sequence
  derived and/or modified sequence opt4 from neuraminidase__InfluenzaB__ABA02232
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgagaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181120 - RNA, 1401 nt, Artificial Sequence
  derived and/or modified sequence opt4 from neuraminidase__InfluenzaB__ABI84039
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaaguacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181121 - RNA, 1401 nt, Artificial Sequence
  derived and/or modified sequence opt4 from neuraminidase__InfluenzaB__ABI84051
augcugcccagcaccauccagacccugacccuguuccugaccagcggcggcgugcugcugagccuguacgugagcgccagccugagcuaccugcuguacagcgacauccugcugagauucagccagaccgagaucaccgcccccaucaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181122 - RNA, 1401 nt, Artificial Sequence
  derived and/or modified sequence opt4 from neuraminidase__InfluenzaB__ABI84062
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaucaugccccuggacugcgccaacgccagcaacgugcaggccgugaacagaagcaccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181123 - RNA, 1401 nt, Artificial Sequence
  derived and/or modified sequence opt4 from neuraminidase__InfluenzaB__ABL76280
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccugaacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181124 - RNA, 1401 nt, Artificial Sequence
  derived and/or modified sequence opt4 from neuraminidase__InfluenzaB__ABL76302
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacccccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagaugcugugggacaccgugaccggcguggacauggcccuguga

SEQ ID NO: 181125 - RNA, 1401 nt, Artificial Sequence
  derived and/or modified sequence opt4 from neuraminidase__InfluenzaB__ABL76313
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccugaacugcgccaacgccagcaacgugcaggccgugaacagaagcgccaccaagggcgugaccuucccccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcguggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181126 - RNA, 1401 nt, Artificial Sequence
  derived and/or modified sequence opt4 from neuraminidase__InfluenzaB__ABL76335
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccugaacugcgccaacgccagcaacgugcaggccgugaacagaagcgccaccaagggcgugacccugccccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181127 - RNA, 1401 nt, Artificial Sequence
  derived and/or modified sequence opt4 from neuraminidase__InfluenzaB__ABL76346
augcugcccagcaccauccagacccugacccuguuccugaccagcggcggcgugcugcugagccuguacgugagcgccagccugagcuaccugcuguacagcgacauccugcugaaguucagccccaaggagaucaccacccccaccaugccccugaacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181128 - RNA, 1401 nt, Artificial Sequence; identical to SEQ ID NO: 181127
  derived and/or modified sequence opt4 from neuraminidase__InfluenzaB__ABL76357

SEQ ID NO: 181129 - RNA, 1401 nt, Artificial Sequence
  derived and/or modified sequence opt4 from neuraminidase__InfluenzaB__ABL76368
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcggcgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181130 - RNA, 1404 nt, Artificial Sequence
  derived and/or modified sequence opt4 from neuraminidase__InfluenzaB__ABL76379
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaccuuccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181131 - RNA, 1401 nt, Artificial Sequence
  derived and/or modified sequence opt4 from neuraminidase__InfluenzaB__ABL76390
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcagcaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggcagcugcgagagcgacggcgacaagggcagcggcggcaucaagggcggcuucgugcaccagagaauggccagcaagaucggcagaugguacagcagaaccaugagcaagaccaagagaaugggcaugggccuguacgugagauacgacggcgaccccuggaccgacagcagcgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181132 - RNA, 1401 nt, Artificial Sequence
  derived and/or modified sequence opt4 from neuraminidase__InfluenzaB__ABL76412
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugauccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacaccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181133 - RNA, 1401 nt, Artificial Sequence
  derived and/or modified sequence opt4 from neuraminidase__InfluenzaB__ABL76423
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181134 - RNA, 1401 nt, Artificial Sequence
  derived and/or modified sequence opt4 from neuraminidase__InfluenzaB__ABL76434
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181135 - RNA, 1401 nt, Artificial Sequence
  derived and/or modified sequence opt4 from neuraminidase__InfluenzaB__ABL76456
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaagcugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181136 - RNA, 1401 nt, Artificial Sequence
  derived and/or modified sequence opt4 from neuraminidase__InfluenzaB__ABL76467
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181137 - RNA, 1401 nt, Artificial Sequence
  derived and/or modified sequence opt4 from neuraminidase__InfluenzaB__ABL76478
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaagcugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181138 - RNA, 1401 nt, Artificial Sequence
  derived and/or modified sequence opt4 from neuraminidase__InfluenzaB__ABL76522
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181139 - RNA, 1401 nt, Artificial Sequence
  derived and/or modified sequence opt4 from neuraminidase__InfluenzaB__ABL76533
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaagagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181140 - RNA, 1401 nt, Artificial Sequence
  derived and/or modified sequence opt4 from neuraminidase__InfluenzaB__ABL76544
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgagagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181141 - RNA, 1401 nt, Artificial Sequence; identical to SEQ ID NO: 181139
  derived and/or modified sequence opt4 from neuraminidase__InfluenzaB__ABL76566

SEQ ID NO: 181142 - RNA, 1401 nt, Artificial Sequence
  derived and/or modified sequence opt4 from neuraminidase__InfluenzaB__ABL76588
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacuacgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181143 - RNA, 1401 nt, Artificial Sequence; identical to SEQ ID NO: 181138
  derived and/or modified sequence opt4 from neuraminidase__InfluenzaB__ABL76599

SEQ ID NO: 181144 - RNA, 1401 nt, Artificial Sequence; identical to SEQ ID NO: 181138
  derived and/or modified sequence opt4 from neuraminidase__InfluenzaB__ABL76610

SEQ ID NO: 181145 - RNA, 1401 nt, Artificial Sequence
  derived and/or modified sequence opt4 from neuraminidase__InfluenzaB__ABL76621
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgagaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacauccccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181146 - RNA, 1401 nt, Artificial Sequence
  derived and/or modified sequence opt4 from neuraminidase__InfluenzaB__ABL76632
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagaugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccguguacugccugaugggcagcggccagcugcugugggacaccgugaccggcguggacauggcccuguga

SEQ ID NO: 181147 - RNA, 1401 nt, Artificial Sequence
  derived and/or modified sequence opt4 from neuraminidase__InfluenzaB__ABL76643
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181148 - RNA, 1401 nt, Artificial Sequence
  derived and/or modified sequence opt4 from neuraminidase__InfluenzaB__ABL76654
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcaccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181149 - RNA, 1401 nt, Artificial Sequence
  derived and/or modified sequence opt4 from neuraminidase__InfluenzaB__ABL76665
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgaguucgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181150 - RNA, 1401 nt, Artificial Sequence
  derived and/or modified sequence opt4 from neuraminidase__InfluenzaB__ABL76676
augcugcccagcaccauccagacccugacccuguuccugaccagcggcggcgugcugcugagccuguacgugagcgccagccugagcuaccugcuguacagcgacauccugcugaaguucagccagaccggcaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181151 - RNA, 1401 nt, Artificial Sequence
  derived and/or modified sequence opt4 from neuraminidase__InfluenzaB__ABL76687
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgaguucgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugcccauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181152 - RNA, 1401 nt, Artificial Sequence
  derived and/or modified sequence opt4 from neuraminidase__InfluenzaB__ABL76698
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcaugacccugcugcugcccgagcccgaguggaccuaccccagacugagcugccccggcagcaccuuccagaaggcccugcugaucagcccccacagauucggcgagaccagaggcaacagcgccccccugaccaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgaggcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181153 - RNA, 1401 nt, Artificial Sequence
  derived and/or modified sequence opt4 from neuraminidase__InfluenzaB__ABL76720
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggagaagcgccgccaccgccaucuacugccugaugggcagcggccagcugcugugggacaccgugaccggcguggacauggcccuguga

SEQ ID NO: 181154 - RNA, 1401 nt, Artificial Sequence
  derived and/or modified sequence opt4 from neuraminidase__InfluenzaB__ABL76731
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgccaucacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181155 - RNA, 1401 nt, Artificial Sequence
  derived and/or modified sequence opt4 from neuraminidase__InfluenzaB__ABL76742
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181156 - RNA, 1401 nt, Artificial Sequence
  derived and/or modified sequence opt4 from neuraminidase__InfluenzaB__ABL76753
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaccggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacaacaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181157 - RNA, 1401 nt, Artificial Sequence; identical to SEQ ID NO: 181126
  derived and/or modified sequence opt4 from neuraminidase__InfluenzaB__ABL76764

SEQ ID NO: 181158 - RNA, 1401 nt, Artificial Sequence; identical to SEQ ID NO: 181126
  derived and/or modified sequence opt4 from neuraminidase__InfluenzaB__ABL76775

SEQ ID NO: 181159 - RNA, 1401 nt, Artificial Sequence
  derived and/or modified sequence opt4 from neuraminidase__InfluenzaB__ABL76797
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181160 - RNA, 1401 nt, Artificial Sequence
  derived and/or modified sequence opt4 from neuraminidase__InfluenzaB__ABL76819
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181161 - RNA, 1401 nt, Artificial Sequence
  derived and/or modified sequence opt4 from neuraminidase__InfluenzaB__ABL76830
augcugcccagcaccauccagacccugacccuguuccugaccagcggcggcgugcugcugagccuguacgugagcgccagccugagcuaccugcuguacagcgacauccugcugaaguucagccccaccaagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181162 - RNA, 1401 nt, Artificial Sequence
  derived and/or modified sequence opt4 from neuraminidase__InfluenzaB__ABL76852
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccaagagaaugggcaugggccuguacgugaaguacgacggcgaccccuggaccgacagcgacgcccuggcccugagcggcgugauggugagcaucgaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181163 - RNA, 1401 nt, Artificial Sequence
  derived and/or modified sequence opt4 from neuraminidase__InfluenzaB__ABL76863
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggccauguga

SEQ ID NO: 181164 - RNA, 1401 nt, Artificial Sequence
  derived and/or modified sequence opt4 from neuraminidase__InfluenzaB__ABL76874
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagcagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucaagcugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181165 - RNA, 1401 nt, Artificial Sequence
  derived and/or modified sequence opt4 from neuraminidase__InfluenzaB__ABL76885
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacuacgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181166 - RNA, 1401 nt, Artificial Sequence
  derived and/or modified sequence opt4 from neuraminidase__InfluenzaB__ABL76896
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcccgaguggauguaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacgccgugaccggcguggacauggcccuguga

SEQ ID NO: 181167 - RNA, 1401 nt, Artificial Sequence
  derived and/or modified sequence opt4 from neuraminidase__InfluenzaB__ABL76918
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugaucggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181168 - RNA, 1401 nt, Artificial Sequence
  derived and/or modified sequence opt4 from neuraminidase__InfluenzaB__ABL76962
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181169 - RNA, 1401 nt, Artificial Sequence; identical to SEQ ID NO: 181099
  derived and/or modified sequence opt4 from neuraminidase__InfluenzaB__ABL76973

SEQ ID NO: 181170 - RNA, 1401 nt, Artificial Sequence
  derived and/or modified sequence opt4 from neuraminidase__InfluenzaB__ABL76984
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaaccugagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagagaaccuggcacagcgccgccaccgccaucuacugccugaugggcagcggccagcugcugugggacaccgugaccggcguggacauggcccuguga

SEQ ID NO: 181171 - RNA, 1401 nt, Artificial Sequence; identical to SEQ ID NO: 181126
  derived and/or modified sequence opt4 from neuraminidase__InfluenzaB__ABL77006

SEQ ID NO: 181172 - RNA, 1401 nt, Artificial Sequence; identical to SEQ ID NO: 181170
  derived and/or modified sequence opt4 from neuraminidase__InfluenzaB__ABL77017

SEQ ID NO: 181173 - RNA, 1401 nt, Artificial Sequence
  derived and/or modified sequence opt4 from neuraminidase__InfluenzaB__ABL77028
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181174 - RNA, 1401 nt, Artificial Sequence
  derived and/or modified sequence opt4 from neuraminidase__InfluenzaB__ABL77039
augcugcccagcaccauccagacccugacccuguuccugaccagcggcggcgugcugcugagccuguacgugagcgccagccugagcuaccugcuguacagcgacauccugcugaaguucagccccaccgagaccaccgcccccaccaugccccuggacugcgccaacgccagcaacgugcaggccgugaacugcagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181175 - RNA, 1401 nt, Artificial Sequence
  derived and/or modified sequence opt4 from neuraminidase__InfluenzaB__ABL77050
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181176 - RNA, 1401 nt, Artificial Sequence
  derived and/or modified sequence opt4 from neuraminidase__InfluenzaB__ABL77072
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaccagccuggacagcgccaacgccagcaacuuccaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcaucaaggagagcggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181177 - RNA, 1401 nt, Artificial Sequence; identical to SEQ ID NO: 181104
  derived and/or modified sequence opt4 from neuraminidase__InfluenzaB__ABL77083

SEQ ID NO: 181178 - RNA, 1401 nt, Artificial Sequence; identical to SEQ ID NO: 181104
  derived and/or modified sequence opt4 from neuraminidase__InfluenzaB__ABL77094

SEQ ID NO: 181179 - RNA, 1401 nt, Artificial Sequence
  derived and/or modified sequence opt4 from neuraminidase__InfluenzaB__ABL77105
augcugcccagcaccauccagacccugacccuguuccugaccagcggcggcgugcugcugagccuguacgugagcgccagccugagcuaccugcuguacagcgacauccugcugaaguucagcagcaccgagaucaccgcccccaccaugccccuggacugcgccaacgccagcaacgugcaggccgugaacagaagcgccaccgagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181180 - RNA, 1401 nt, Artificial Sequence; identical to SEQ ID NO: 181104
  derived and/or modified sequence opt4 from neuraminidase__InfluenzaB__ABL77127

SEQ ID NO: 181181 - RNA, 1401 nt, Artificial Sequence
  derived and/or modified sequence opt4 from neuraminidase__InfluenzaB__ABL77138
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaccagccuggacagcgccaacgccagcaacuuccaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcaucgaggagcccggcugguacagcuucggcuucgagaucaaggacaagaagugcgacgugcccugcaucggcaucgagauggugcacgacggcggcaagaccaccugguacagcgccgccaccgccaucuacugccugaugggcagcggccagcugcugugggacaccgugaccggcguggacauggcccuguga

SEQ ID NO: 181182 - RNA, 1401 nt, Artificial Sequence; identical to SEQ ID NO: 181104
  derived and/or modified sequence opt4 from neuraminidase__InfluenzaB__ABL77149

SEQ ID NO: 181183 - RNA, 1401 nt, Artificial Sequence
  derived and/or modified sequence opt4 from neuraminidase__InfluenzaB__ABL77160
augcugcccagcaccauccagacccugacccuguuccugaccagcggcggcgugcugcugagccuguacgugagcgccagccugagcuaccugcuguacagcgacauccugcugaaguucagccagaccaagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacagaggcagcggcggcaucaagggcggcuucgugcaccagagaauggagagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccaccaucuacugccugaugggcagcggccagcugcugugggacaccgugaccggcguggacauggcccuguga

SEQ ID NO: 181184 - RNA, 1401 nt, Artificial Sequence; identical to SEQ ID NO: 181136
  derived and/or modified sequence opt4 from neuraminidase__InfluenzaB__ABL77171

SEQ ID NO: 181185 - RNA, 1401 nt, Artificial Sequence
  derived and/or modified sequence opt4 from neuraminidase__InfluenzaB__ABL77182
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaccagccuggacagcgccaacgccagcaacuuccaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucgugaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccaucaccggcguggacauggcccuguga

SEQ ID NO: 181186 - RNA, 1401 nt, Artificial Sequence; identical to SEQ ID NO: 181111
  derived and/or modified sequence opt4 from neuraminidase__InfluenzaB__ABL77193

SEQ ID NO: 181187 - RNA, 1401 nt, Artificial Sequence
  derived and/or modified sequence opt4 from neuraminidase__InfluenzaB__ABL77204
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugauccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacagcgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181188 - RNA, 1401 nt, Artificial Sequence
  derived and/or modified sequence opt4 from neuraminidase__InfluenzaB__ABL77215
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181189 - RNA, 1401 nt, Artificial Sequence; identical to SEQ ID NO: 181147
  derived and/or modified sequence opt4 from neuraminidase__InfluenzaB__ABL77226

SEQ ID NO: 181190 - RNA, 1401 nt, Artificial Sequence
  derived and/or modified sequence opt4 from neuraminidase__InfluenzaB__ABL77237
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181191 - RNA, 1401 nt, Artificial Sequence
  derived and/or modified sequence opt4 from neuraminidase__InfluenzaB__ABL77248
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaugagccuggacugcgccaacgccagcaacgugcaggccgccaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgagaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccccagcggcgugauggugagcaugaaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181192 - RNA, 1401 nt, Artificial Sequence
  derived and/or modified sequence opt4 from neuraminidase__InfluenzaB__ABL77259
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaaggugccccuggacugcgccaacgccagcaacgugcaggccgugaacagaagcgccaccaagggcaugacccugcugcugagcgagcccgaguggaccuaccccagacugagcugccagggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccccagcggcgugauggugagcaugaaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181193 - RNA, 1401 nt, Artificial Sequence
  derived and/or modified sequence opt4 from neuraminidase__InfluenzaB__ABL77270
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcaugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgaggcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181194 - RNA, 1401 nt, Artificial Sequence
  derived and/or modified sequence opt4 from neuraminidase__InfluenzaB__ABL77281
augcugcccagcaccauccagacccugacccuguuccugaccagcggcggcgugcugcugagccuguacgugagcgugagccugagcuaccugcuguacagcgacauccugcugagauucagccccaccgagaucaccgcccccaccaugccccuggacugcgccaacgccagcaacgugcaggccgugaacagaagcgccaccaagggcaugacccugagacugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcgagaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgaggcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181195 - RNA, 1401 nt, Artificial Sequence
  derived and/or modified sequence opt4 from neuraminidase__InfluenzaB__ABL77292
augcugcccagcaccauccagacccugacccuguuccugaccagcggcggcgugcugcugagccuguacgugagcgccagccugagcuaccugcuguacagcggcgugcugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagaugagacaccugaucagcgugaagcugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggccugggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181196 - RNA, 1398 nt, Artificial Sequence
  derived and/or modified sequence opt4 from neuraminidase__InfluenzaB__ABL77303
augcugcccagcaccauccagacccugacccuguuccugaccagcggcggcgugcugcugagccuguacgugagcgcccugcugagcuaccugcuguacagcgacauccugcugaaguucagccccaagaucaucgcccccaccaucagccuggacugcgccaacgccagcaacgugcaggccgugaaccacagcgccaccaaggagaugaccuuccugcugcccgagcccgaguggaccuaccccagacugagcugccagggcagcaucuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcgugaagggcggcuucgugcaccagagaaucgccagcaagaucggcagaugguacagcagaaccaugagcaagaccgagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181197 - RNA, 1398 nt, Artificial Sequence
  derived and/or modified sequence opt4 from neuraminidase__InfluenzaB__ABL77314
augcugcccagcaccauccagacccugacccuguuccugaccagcggcggcgugcugcugagccuguacgugagcgcccugcugagcuaccugcuguacagcgacgugcugcugaaguucagccccaagaucaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggccacggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucagagacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181198 - RNA, 1401 nt, Artificial Sequence
  derived and/or modified sequence opt4 from neuraminidase__InfluenzaB__ABL77325
augcugcccagcaccauccagacccugacccuguuccugaccagcggcggcgugcugcugagccuguacgugagcgcccugcugagcuacagccuguacagcgacauccugcugaaguucagccccaccaagaccaucgcccccaccaugagccuggacugcgccaacgccagcaacgugcaggccgugaaccacagcgccaccaagggcaugacccugcugcugcccgagcccgaguggaccuaccccagacugagcugccagggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugagccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggaccacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgagagacugggcauggagcuguacgugaaguacgacggcgaccccuggaccgacagcgacgcccuggcccccagcggcgugauggugagcgccgaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181199 - RNA, 1401 nt, Artificial Sequence
  derived and/or modified sequence opt4 from neuraminidase__InfluenzaB__ABL77336
augcugcccagcaccauccagacccugacccuguuccugaccagcggcggcgugcugcugagccuguacgugagcgccagccugagcuaccugcuguacagcgacauccugcugaaguucagccccaccgagaucaccgccccccccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgccaucacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgacagaaugggcauggagcuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccaccaucuacugccugaugggcagcggccagcugcugugggacaccgugaccggcguggacauggcccuguga

SEQ ID NO: 181200 - RNA, 1401 nt, Artificial Sequence
  derived and/or modified sequence opt4 from neuraminidase__InfluenzaB__ABL77347
augcugcccagcaccauccagacccugacccuguuccugaccagcggcggcgugcugcugagccuguacgugagcgccagccugagcuaccugcuguacagcgacauccugcugaaguucagccccaccaagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181201 - RNA, 1398 nt, Artificial Sequence
  derived and/or modified sequence opt4 from neuraminidase__InfluenzaB__ABL77380
augcugcccagcaccauccagacccugacccuguuccugaccagcggcggcgugcugcugagccuguacgugagcgcccugcugagcuaccugcuguacagcgacauccugcugaaguucagccccaagaucaucgcccccaccaccagccuggacugcgccaacgccagcaacgugcaggccgugaaccacagcgccaccaaggagaugaaguuccugccccccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcgugaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagagaaccuggcacagcgccgccaccgccaucuacugccugaugggcagcggccagcugcugugggacaccgugaccggcgugaacauggcccuguga

SEQ ID NO: 181202 - RNA, 1401 nt, Artificial Sequence
  derived and/or modified sequence opt4 from neuraminidase__InfluenzaB__ABL77391
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181203 - RNA, 1401 nt, Artificial Sequence
  derived and/or modified sequence opt4 from neuraminidase__InfluenzaB__ABL84344
augcugcccagcaccauccagacccugacccuguuccugaccagcggcggcgugcugcugagccuguacgugagcgccagccugagcuaccugcuguacagcgacauccugcugaaguucagcagcaccgagaucaccgcccccaccaugccccugaacugcgccaacgccagcaacgugcaggccgugaaccacagcgccaccaagggcgugacccugccccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcgugagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181204 - RNA, 1401 nt, Artificial Sequence
  derived and/or modified sequence opt4 from neuraminidase__InfluenzaB__ABN50397
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccugaacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggaccuguga

SEQ ID NO: 181205 - RNA, 1401 nt, Artificial Sequence
  derived and/or modified sequence opt4 from neuraminidase__InfluenzaB__ABN50408
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccugaacugcgccaacgccagcaacgugcaggccgugaacagaagcgccaccaagggcgugacccugccccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181206 - RNA, 1401 nt, Artificial Sequence
  derived and/or modified sequence opt4 from neuraminidase__InfluenzaB__ABN50419
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccugugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181207 - RNA, 1401 nt, Artificial Sequence
  derived and/or modified sequence opt4 from neuraminidase__InfluenzaB__ABN50430
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181208 - RNA, 1401 nt, Artificial Sequence; identical to SEQ ID NO: 181190
  derived and/or modified sequence opt4 from neuraminidase__InfluenzaB__ABN50463

SEQ ID NO: 181209 - RNA, 1401 nt, Artificial Sequence; identical to SEQ ID NO: 181104
  derived and/or modified sequence opt4 from neuraminidase__InfluenzaB__ABN50474

SEQ ID NO: 181210 - RNA, 1401 nt, Artificial Sequence
  derived and/or modified sequence opt4 from neuraminidase__InfluenzaB__ABN50485
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgaguucaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181211 - RNA, 1401 nt, Artificial Sequence
  derived and/or modified sequence opt4 from neuraminidase__InfluenzaB__ABN50496
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagagagugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181212 - RNA, 1401 nt, Artificial Sequence
  derived and/or modified sequence opt4 from neuraminidase__InfluenzaB__ABN50507
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccugaacugcgccaacgccagcaacgugcaggccgugaacagaagcgccaccaagggcgugacccugccccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcagacacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181213 - RNA, 1401 nt, Artificial Sequence; identical to SEQ ID NO: 181111
  derived and/or modified sequence opt4 from neuraminidase__InfluenzaB__ABN50518

SEQ ID NO: 181214 - RNA, 1401 nt, Artificial Sequence; identical to SEQ ID NO: 181111
  derived and/or modified sequence opt4 from neuraminidase__InfluenzaB__ABN50529

SEQ ID NO: 181215 - RNA, 1401 nt, Artificial Sequence; identical to SEQ ID NO: 181104
  derived and/or modified sequence opt4 from neuraminidase__InfluenzaB__ABN50540

SEQ ID NO: 181216 - RNA, 1401 nt, Artificial Sequence; identical to SEQ ID NO: 181136
  derived and/or modified sequence opt4 from neuraminidase__InfluenzaB__ABN50551

SEQ ID NO: 181217 - RNA, 1401 nt, Artificial Sequence
  derived and/or modified sequence opt4 from neuraminidase__InfluenzaB__ABN50562
augcugcccagcaccauccagacccugacccuguuccugaccagcggcggcgcccugcugagccuguacgugagcgcccugcugagcuaccugcuguacagcgacauccugcugaaguucagccccaccaaggugaucgcccccaccaugagccuggacuacaccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcagaugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcaacggcggcaucaagggcggcuucgugcaccagagaauggccagcagaaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181218 - RNA, 1401 nt, Artificial Sequence; identical to SEQ ID NO: 181207
  derived and/or modified sequence opt4 from neuraminidase__InfluenzaB__ABN50573

SEQ ID NO: 181219 - RNA, 1401 nt, Artificial Sequence
  derived and/or modified sequence opt4 from neuraminidase__InfluenzaB__ABN50584
augcugcccagcaccauccagacccugacccuguuccugaccagcggcggcgugcugcugagccuguacgugagcgccagccugagcuaccugcuguacagcgacauccugcugaaguucagccccaccgagaucaccgccagcaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagagcgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181220 - RNA, 1401 nt, Artificial Sequence; identical to SEQ ID NO: 181104
  derived and/or modified sequence opt4 from neuraminidase__InfluenzaB__ABN50595

SEQ ID NO: 181221 - RNA, 1398 nt, Artificial Sequence
  derived and/or modified sequence opt4 from neuraminidase__InfluenzaB__ABN50606
augcugcccagcaccauccagacccugacccuguuccugaccagcggcggcgugcugcugagccuguacgugagcgccagccugagcuaccugcuguacagcgacauccugcugagauucagcagcaagaucaccgcccccaccaugacccuggacugcgccaacgccagcaacgugcaggccgugaacagaagcgccaccaaggagaugaccuuccugcugcccgagcccgaguggaccuaccccagacugagcugccagggcagcaccuuccagaaggcccugcugaucagcccccacagauucggcgaggccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcgacggcgacaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccccagcggcgugauggugagcaugaaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181222 - RNA, 1398 nt, Artificial Sequence
  derived and/or modified sequence opt4 from neuraminidase__InfluenzaB__ABN50628
augcugcccagcaccauccagacccugacccuguuccugaccagcggcggcgugcugcugagccuguacgugagcgcccugcugagcuaccugcuguacagcgacauccugcugaaguucagccccaagaucaucgcccccaccaugagccuggacugcgccaacgccagcaacgugcaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcgugaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181223 - RNA, 1398 nt, Artificial Sequence
  derived and/or modified sequence opt4 from neuraminidase__InfluenzaB__ABN50639
augcugcccagcaccauccagacccugacccuguuccugaccagcggcggcgugcugcugagccuguacgugagcgcccugcugagcuaccugcuguacagcgacauccugcugaaguucagccccaagaucaucgcccccaccaugagccuggacugcgccaacgccagcaacgugcaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccuggugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcgugaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181224 - RNA, 1398 nt, Artificial Sequence
  derived and/or modified sequence opt4 from neuraminidase__InfluenzaB__ABN50650
augcugcccagcaccauccagacccugacccuguuccugaccagcggcggcgugcugcugagccuguacgugagcgcccugcugagcuaccugcuguacagcgacgugcugcugaaguucagccccaagaucaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggccacggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181225 - RNA, 1398 nt, Artificial Sequence
  derived and/or modified sequence opt4 from neuraminidase__InfluenzaB__ABN50661
augcugcccagcaccauccagacccugacccuguuccugaccagcggcggcgugcugcugagccuguacgugagcgcccugcugagcuaccugcuguacagcgacgugcugcugaaguucagccccaagaugaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggccacggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181226 - RNA, 1401 nt, Artificial Sequence
  derived and/or modified sequence opt4 from neuraminidase__InfluenzaB__ABN50683
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggccugggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccugagcggcgugauggugcccauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181227 - RNA, 1401 nt, Artificial Sequence
  derived and/or modified sequence opt4 from neuraminidase__InfluenzaB__ABN50694
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181228 - RNA, 1398 nt, Artificial Sequence
  derived and/or modified sequence opt4 from neuraminidase__InfluenzaB__ABN50705
augcugcccagcaccauccagacccugacccuguuccugacccugggcggcgugcugcugagccuguacgugagcgcccugcugagcuaccugcuguacagcgacgugcugcugaaguucagccccaagaugaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggccacggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181229 - RNA, 1401 nt, Artificial Sequence
  derived and/or modified sequence opt4 from neuraminidase__InfluenzaB__ABN50716
augcugcccagcaccauccagacccugacccuguuccugaccagcggcggcgugcugcugagccuguacgugagcgccagccugagcuaccugcuguacagcggcauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181230 - RNA, 1401 nt, Artificial Sequence
  derived and/or modified sequence opt4 from neuraminidase__InfluenzaB__ABN50727
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181231 - RNA, 1401 nt, Artificial Sequence; identical to SEQ ID NO: 181173
  derived and/or modified sequence opt4 from neuraminidase__InfluenzaB__ABN50738

SEQ ID NO: 181232 - RNA, 1401 nt, Artificial Sequence
  derived and/or modified sequence opt4 from neuraminidase__InfluenzaB__ABN50749
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181233 - RNA, 1398 nt, Artificial Sequence
  derived and/or modified sequence opt4 from neuraminidase__InfluenzaB__ABN51188
augcugcccagcaccauccagacccugacccuguuccugaccagcggcggcgugcugcugagccuguacgugagcgcccugcugagcuaccugcuguacagcgacauccugcugaaguucagccccaagaucaucgcccccaccaugcugcuggacugcgccaacgccagcaacgugcaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcgugaagggcggcuucgugcaccagagaauggccagcaagaucggcagaugguacagcagaaccaugagcaagaccgagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181234 - RNA, 1398 nt, Artificial Sequence; identical to SEQ ID NO: 181222
  derived and/or modified sequence opt4 from neuraminidase__InfluenzaB__ABN51199

SEQ ID NO: 181235 - RNA, 1401 nt, Artificial Sequence
  derived and/or modified sequence opt4 from neuraminidase__InfluenzaB__ABN58665
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181236 - RNA, 1401 nt, Artificial Sequence; identical to SEQ ID NO: 181123
  derived and/or modified sequence opt4 from neuraminidase__InfluenzaB__ABN59449

SEQ ID NO: 181237 - RNA, 1398 nt, Artificial Sequence; identical to SEQ ID NO: 181201
  derived and/or modified sequence opt4 from neuraminidase__InfluenzaB__ABR15999

SEQ ID NO: 181238 - RNA, 1401 nt, Artificial Sequence; identical to SEQ ID NO: 181230
  derived and/or modified sequence opt4 from neuraminidase__InfluenzaB__ABR16010

SEQ ID NO: 181239 - RNA, 1401 nt, Artificial Sequence
  derived and/or modified sequence opt4 from neuraminidase__InfluenzaB__ABR16021
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagaaagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181240 - RNA, 1401 nt, Artificial Sequence; identical to SEQ ID NO: 181155
  derived and/or modified sequence opt4 from neuraminidase__InfluenzaB__ACA64903

SEQ ID NO: 181241 - RNA, 1401 nt, Artificial Sequence
  derived and/or modified sequence opt4 from neuraminidase__InfluenzaB__ACA64914
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggacgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181242 - RNA, 1401 nt, Artificial Sequence; identical to SEQ ID NO: 181155
  derived and/or modified sequence opt4 from neuraminidase__InfluenzaB__ACA64936

SEQ ID NO: 181243 - RNA, 1401 nt, Artificial Sequence
  derived and/or modified sequence opt4 from neuraminidase__InfluenzaB__ACA64969
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181244 - RNA, 1401 nt, Artificial Sequence
  derived and/or modified sequence opt4 from neuraminidase__InfluenzaB__ACA64980
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugagccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccagcaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181245 - RNA, 1401 nt, Artificial Sequence
  derived and/or modified sequence opt4 from neuraminidase__InfluenzaB__ACA64991
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucggcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181246 - RNA, 1401 nt, Artificial Sequence; identical to SEQ ID NO: 181155
  derived and/or modified sequence opt4 from neuraminidase__InfluenzaB__ACA65013

SEQ ID NO: 181247 - RNA, 1401 nt, Artificial Sequence; identical to SEQ ID NO: 181155
  derived and/or modified sequence opt4 from neuraminidase__InfluenzaB__ACA65024

SEQ ID NO: 181248 - RNA, 1401 nt, Artificial Sequence
  derived and/or modified sequence opt4 from neuraminidase__InfluenzaB__ACA65035
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccagcaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181249 - RNA, 1401 nt, Artificial Sequence; identical to SEQ ID NO: 181155
  derived and/or modified sequence opt4 from neuraminidase__InfluenzaB__ACA65046

SEQ ID NO: 181250 - RNA, 1401 nt, Artificial Sequence
  derived and/or modified sequence opt4 from neuraminidase__InfluenzaB__ACA65057
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggaggccgacaccgccgagaucagacugaugugcaccgacaccuaccuggacacccccagacccgacgacggcagcaucaccggccccugcgaguucaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181251 - RNA, 1401 nt, Artificial Sequence; identical to SEQ ID NO: 181155
  derived and/or modified sequence opt4 from neuraminidase__InfluenzaB__ACA65068

SEQ ID NO: 181252 - RNA, 1401 nt, Artificial Sequence; identical to SEQ ID NO: 181155
  derived and/or modified sequence opt4 from neuraminidase__InfluenzaB__ACA65079

SEQ ID NO: 181253 - RNA, 1401 nt, Artificial Sequence; identical to SEQ ID NO: 181155
  derived and/or modified sequence opt4 from neuraminidase__InfluenzaB__ACA65090

SEQ ID NO: 181254 - RNA, 1401 nt, Artificial Sequence; identical to SEQ ID NO: 181155
  derived and/or modified sequence opt4 from neuraminidase__InfluenzaB__ACA65101

SEQ ID NO: 181255 - RNA, 1401 nt, Artificial Sequence
  derived and/or modified sequence opt4 from neuraminidase__InfluenzaB__ACA96567
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgagugggccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcaucauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181256 - RNA, 1401 nt, Artificial Sequence; identical to SEQ ID NO: 181155
  derived and/or modified sequence opt4 from neuraminidase__InfluenzaB__ACA96578

SEQ ID NO: 181257 - RNA, 1401 nt, Artificial Sequence; identical to SEQ ID NO: 181243
  derived and/or modified sequence opt4 from neuraminidase__InfluenzaB__ACA96589

SEQ ID NO: 181258 - RNA, 1401 nt, Artificial Sequence; identical to SEQ ID NO: 181155
  derived and/or modified sequence opt4 from neuraminidase__InfluenzaB__ACA96600

SEQ ID NO: 181259 - RNA, 1401 nt, Artificial Sequence
  derived and/or modified sequence opt4 from neuraminidase__InfluenzaB__ACA96611
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacuacgccaacgccagcaacgugcacgccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggcagacugcugugggacaccgugaccggcguggacauggcccuguga

SEQ ID NO: 181260 - RNA, 1401 nt, Artificial Sequence
  derived and/or modified sequence opt4 from neuraminidase__InfluenzaB__ACA96622
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaucggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181261 - RNA, 1401 nt, Artificial Sequence; identical to SEQ ID NO: 181243
  derived and/or modified sequence opt4 from neuraminidase__InfluenzaB__ACA96633

SEQ ID NO: 181262 - RNA, 1401 nt, Artificial Sequence
  derived and/or modified sequence opt4 from neuraminidase__InfluenzaB__ACA96644
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcaucaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugaugaucagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181263 - RNA, 1401 nt, Artificial Sequence
  derived and/or modified sequence opt4 from neuraminidase__InfluenzaB__ACA96655
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181264 - RNA, 1401 nt, Artificial Sequence
  derived and/or modified sequence opt4 from neuraminidase__InfluenzaB__ACA96666
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacagaggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacgacggcaaggagaccuggcacagcgccgccaccgccaucuacugccugaugggcagcggccagcugcugugggacaccgugaccggcguggacauggcccuguga

SEQ ID NO: 181265 - RNA, 1401 nt, Artificial Sequence
  derived and/or modified sequence opt4 from neuraminidase__InfluenzaB__ACD56581
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181266 - RNA, 1401 nt, Artificial Sequence
  derived and/or modified sequence opt4 from neuraminidase__InfluenzaB__ACF33793
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacauccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181267 - RNA, 1401 nt, Artificial Sequence
  derived and/or modified sequence opt4 from neuraminidase__InfluenzaB__ACF33795
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagaagaugggcaugggccuguacgugaaguacgacggcgagcccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181268 - RNA, 1401 nt, Artificial Sequence
  derived and/or modified sequence opt4 from neuraminidase__InfluenzaB__ACF33797
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacacccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugaucggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181269 - RNA, 1401 nt, Artificial Sequence; identical to SEQ ID NO: 181248
  derived and/or modified sequence opt4 from neuraminidase__InfluenzaB__ACF41662

SEQ ID NO: 181270 - RNA, 1401 nt, Artificial Sequence
  derived and/or modified sequence opt4 from neuraminidase__InfluenzaB__ACF54140
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccaagggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacagaggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181271 - RNA, 1401 nt, Artificial Sequence
  derived and/or modified sequence opt4 from neuraminidase__InfluenzaB__ACF54151
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcaacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181272 - RNA, 1401 nt, Artificial Sequence
  derived and/or modified sequence opt4 from neuraminidase__InfluenzaB__ACF54162
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacaacuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181273 - RNA, 1401 nt, Artificial Sequence
  derived and/or modified sequence opt4 from neuraminidase__InfluenzaB__ACF54184
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccaaggaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181274 - RNA, 1401 nt, Artificial Sequence
  derived and/or modified sequence opt4 from neuraminidase__InfluenzaB__ACF54206
augcugcccagcaccauccagacccugacccuguuccugaccagcggcggcgugcugcugagccuguacgugagcgccagccugagcuaccugcuguacagcgacauccugcugaaguucagcaccaccgagaccaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181275 - RNA, 1401 nt, Artificial Sequence
  derived and/or modified sequence opt4 from neuraminidase__InfluenzaB__ACF54217
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181276 - RNA, 1401 nt, Artificial Sequence; identical to SEQ ID NO: 181167
  derived and/or modified sequence opt4 from neuraminidase__InfluenzaB__ACF54228

SEQ ID NO: 181277 - RNA, 1401 nt, Artificial Sequence; identical to SEQ ID NO: 181188
  derived and/or modified sequence opt4 from neuraminidase__InfluenzaB__ACF54239

SEQ ID NO: 181278 - RNA, 1401 nt, Artificial Sequence
  derived and/or modified sequence opt4 from neuraminidase__InfluenzaB__ACF54261
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccuggugagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181279 - RNA, 1401 nt, Artificial Sequence
  derived and/or modified sequence opt4 from neuraminidase__InfluenzaB__ACF54272
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181280 - RNA, 1401 nt, Artificial Sequence
  derived and/or modified sequence opt4 from neuraminidase__InfluenzaB__ACF54283
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccuggugagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181281 - RNA, 1401 nt, Artificial Sequence
  derived and/or modified sequence opt4 from neuraminidase__InfluenzaB__ACF54294
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaucccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181282 - RNA, 1401 nt, Artificial Sequence
  derived and/or modified sequence opt4 from neuraminidase__InfluenzaB__ACF54305
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcguggagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181283 - RNA, 1401 nt, Artificial Sequence
  derived and/or modified sequence opt4 from neuraminidase__InfluenzaB__ACF54316
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugaucggcgugauggugagcauggaggagcccggcugguacagcuucggcuucgagaucaaggacaagaacugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181284 - RNA, 1404 nt, Artificial Sequence
  derived and/or modified sequence opt4 from neuraminidase__InfluenzaB__ACF54338
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacgacggcgaccccugggccgacagcgacgcccugguguucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181285 - RNA, 1401 nt, Artificial Sequence
  derived and/or modified sequence opt4 from neuraminidase__InfluenzaB__ACF54349
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucaacccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181286 - RNA, 1401 nt, Artificial Sequence
  derived and/or modified sequence opt4 from neuraminidase__InfluenzaB__ACF54371
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaccggcagcggccagcugcugugggacaccgugaccggcguggacauggcccuguga

SEQ ID NO: 181287 - RNA, 1401 nt, Artificial Sequence
  derived and/or modified sequence opt4 from neuraminidase__InfluenzaB__ACI22549
augcugcccagcaccauccagacccugacccuguuccugaccagcggcggcgugcugcugagccuguacgugagcgccagccugagcuaccugcuguacagcgacauccugcugaaguucagccccaccgagaucaccgccagaaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggaggacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugaucggcgugauggugagcauggaggagcccggcugguacagcuucggcuucgagaucaaggacaagaacugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181288 - RNA, 1401 nt, Artificial Sequence
  derived and/or modified sequence opt4 from neuraminidase__InfluenzaB__ACI22551
augcugcccagcaccauccagacccugacccuguuccugaccagcggcggcgugcugcugagccuguacgugagcgccagccugagcuaccugcuguacagcgacauccugcugaaguucagccccaccgagaucaccgcccugaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugaucggcgugauggugagcauggaggagcccggcugguacagcuucggcuucgagaucaaggacaagaacugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181289 - RNA, 1401 nt, Artificial Sequence; identical to SEQ ID NO: 181288
  derived and/or modified sequence opt4 from neuraminidase__InfluenzaB__ACI22555

SEQ ID NO: 181290 - RNA, 1401 nt, Artificial Sequence; identical to SEQ ID NO: 181155
  derived and/or modified sequence opt4 from neuraminidase__InfluenzaB__ACI22557

SEQ ID NO: 181291 - RNA, 1401 nt, Artificial Sequence
  derived and/or modified sequence opt4 from neuraminidase__InfluenzaB__ACI22559
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaaccugagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181292 - RNA, 1401 nt, Artificial Sequence
  derived and/or modified sequence opt4 from neuraminidase__InfluenzaB__ACI22561
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcggcacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181293 - RNA, 1401 nt, Artificial Sequence; identical to SEQ ID NO: 181155
  derived and/or modified sequence opt4 from neuraminidase__InfluenzaB__ACI22563

SEQ ID NO: 181294 - RNA, 1401 nt, Artificial Sequence
  derived and/or modified sequence opt4 from neuraminidase__InfluenzaB__ACI22565
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaucgagagaaagggcaugggccuguacgugaaguacgacggcgaccccugggccgacagcgacgcccuggccuucagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181295 - RNA, 1401 nt, Artificial Sequence; identical to SEQ ID NO: 181155
  derived and/or modified sequence opt4 from neuraminidase__InfluenzaB__ACI22567

SEQ ID NO: 181296 - RNA, 1401 nt, Artificial Sequence; identical to SEQ ID NO: 181155
  derived and/or modified sequence opt4 from neuraminidase__InfluenzaB__ACI22569

SEQ ID NO: 181297 - RNA, 1401 nt, Artificial Sequence
  derived and/or modified sequence opt4 from neuraminidase__InfluenzaB__ACJ53908
augcugcacagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcagcgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181298 - RNA, 1401 nt, Artificial Sequence; identical to SEQ ID NO: 181173
  derived and/or modified sequence opt4 from neuraminidase__InfluenzaB__ACN32560

SEQ ID NO: 181299 - RNA, 1401 nt, Artificial Sequence; identical to SEQ ID NO: 181243
  derived and/or modified sequence opt4 from neuraminidase__InfluenzaB__ACN32582

SEQ ID NO: 181300 - RNA, 1401 nt, Artificial Sequence; identical to SEQ ID NO: 181155
  derived and/or modified sequence opt4 from neuraminidase__InfluenzaB__ACN32593

SEQ ID NO: 181301 - RNA, 1401 nt, Artificial Sequence
  derived and/or modified sequence opt4 from neuraminidase__InfluenzaB__ACN32604
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgaguucaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181302 - RNA, 1401 nt, Artificial Sequence; identical to SEQ ID NO: 181155
  derived and/or modified sequence opt4 from neuraminidase__InfluenzaB__ACN32615

SEQ ID NO: 181303 - RNA, 1401 nt, Artificial Sequence
  derived and/or modified sequence opt4 from neuraminidase__InfluenzaB__ACN32775
augcugcccagcaccauccagacccugacccuguuccugaccagcggcggcgugcugcugagccuguacgugagcgccagccugagcuaccugcuguacagcgacauccugcugaaguucagccccaccgagaucaacgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagagcaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181304 - RNA, 1401 nt, Artificial Sequence; identical to SEQ ID NO: 181155
  derived and/or modified sequence opt4 from neuraminidase__InfluenzaB__ACN32786

SEQ ID NO: 181305 - RNA, 1401 nt, Artificial Sequence
  derived and/or modified sequence opt4 from neuraminidase__InfluenzaB__ACO05928
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugcccauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181306 - RNA, 1401 nt, Artificial Sequence; identical to SEQ ID NO: 181167
  derived and/or modified sequence opt4 from neuraminidase__InfluenzaB__ACO05950

SEQ ID NO: 181307 - RNA, 1401 nt, Artificial Sequence
  derived and/or modified sequence opt4 from neuraminidase__InfluenzaB__ACO05961
augcugcccagcaccauccagacccugacccuguuccugaccagcggcggcgugcugcugagccuguacgugagcgccagccugagcuaccugcccuacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181308 - RNA, 1401 nt, Artificial Sequence
  derived and/or modified sequence opt4 from neuraminidase__InfluenzaB__ACO05972
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181309 - RNA, 1401 nt, Artificial Sequence; identical to SEQ ID NO: 181308
  derived and/or modified sequence opt4 from neuraminidase__InfluenzaB__ACO05983

SEQ ID NO: 181310 - RNA, 1401 nt, Artificial Sequence; identical to SEQ ID NO: 181308
  derived and/or modified sequence opt4 from neuraminidase__InfluenzaB__ACO05994

SEQ ID NO: 181311 - RNA, 1401 nt, Artificial Sequence
  derived and/or modified sequence opt4 from neuraminidase__InfluenzaB__ACO06005
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacagaggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181312 - RNA, 1401 nt, Artificial Sequence
  derived and/or modified sequence opt4 from neuraminidase__InfluenzaB__ACO06027
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacaugacccuguga

SEQ ID NO: 181313 - RNA, 1401 nt, Artificial Sequence
  derived and/or modified sequence opt4 from neuraminidase__InfluenzaB__ACO06066
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcguggccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacaugacccuguga

SEQ ID NO: 181314 - RNA, 1401 nt, Artificial Sequence
  derived and/or modified sequence opt4 from neuraminidase__InfluenzaB__ACO94665
augcugcccagcaccauccagacccugacccuguuccugaccagcggcggcgugcugcugagccuguacgugagcgccagccugagcuaccugcuguacagcgacauccugcugaaguucagccccaccgagaucaccgccagcaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181315 - RNA, 1401 nt, Artificial Sequence; identical to SEQ ID NO: 181155
  derived and/or modified sequence opt4 from neuraminidase__InfluenzaB__ACQ45607

SEQ ID NO: 181316 - RNA, 1401 nt, Artificial Sequence
  derived and/or modified sequence opt4 from neuraminidase__InfluenzaB__ACQ45610
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccgugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaaguacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181317 - RNA, 1401 nt, Artificial Sequence; identical to SEQ ID NO: 181155
  derived and/or modified sequence opt4 from neuraminidase__InfluenzaB__ACQ45613

SEQ ID NO: 181318 - RNA, 1401 nt, Artificial Sequence; identical to SEQ ID NO: 181311
  derived and/or modified sequence opt4 from neuraminidase__InfluenzaB__ACR15626

SEQ ID NO: 181319 - RNA, 1401 nt, Artificial Sequence; identical to SEQ ID NO: 181311
  derived and/or modified sequence opt4 from neuraminidase__InfluenzaB__ACR15637

SEQ ID NO: 181320 - RNA, 1401 nt, Artificial Sequence; identical to SEQ ID NO: 181282
  derived and/or modified sequence opt4 from neuraminidase__InfluenzaB__ACR15648

SEQ ID NO: 181321 - RNA, 1401 nt, Artificial Sequence; identical to SEQ ID NO: 181311
  derived and/or modified sequence opt4 from neuraminidase__InfluenzaB__ACR15659

SEQ ID NO: 181322 - RNA, 1401 nt, Artificial Sequence; identical to SEQ ID NO: 181311
  derived and/or modified sequence opt4 from neuraminidase__InfluenzaB__ACR15670

SEQ ID NO: 181323 - RNA, 1401 nt, Artificial Sequence; identical to SEQ ID NO: 181136
  derived and/or modified sequence opt4 from neuraminidase__InfluenzaB__ACR15681

SEQ ID NO: 181324 - RNA, 1401 nt, Artificial Sequence
  derived and/or modified sequence opt4 from neuraminidase__InfluenzaB__ACR15692
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccugggcugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacaacgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181325 - RNA, 1401 nt, Artificial Sequence; identical to SEQ ID NO: 181312
  derived and/or modified sequence opt4 from neuraminidase__InfluenzaB__ACR15703

SEQ ID NO: 181326 - RNA, 1401 nt, Artificial Sequence; identical to SEQ ID NO: 181312
  derived and/or modified sequence opt4 from neuraminidase__InfluenzaB__ACR15714

SEQ ID NO: 181327 - RNA, 1401 nt, Artificial Sequence; identical to SEQ ID NO: 181227
  derived and/or modified sequence opt4 from neuraminidase__InfluenzaB__ACR15725

SEQ ID NO: 181328 - RNA, 1401 nt, Artificial Sequence; identical to SEQ ID NO: 181188
  derived and/or modified sequence opt4 from neuraminidase__InfluenzaB__ACR15736

SEQ ID NO: 181329 - RNA, 1401 nt, Artificial Sequence; identical to SEQ ID NO: 181311
  derived and/or modified sequence opt4 from neuraminidase__InfluenzaB__ACR39340

SEQ ID NO: 181330 - RNA, 1401 nt, Artificial Sequence
  derived and/or modified sequence opt4 from neuraminidase__InfluenzaB__ADL28399
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaucaucgagugcgccugcagagacagcagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181331 - RNA, 1401 nt, Artificial Sequence; identical to SEQ ID NO: 181308
  derived and/or modified sequence opt4 from neuraminidase__InfluenzaB__ADN32822

SEQ ID NO: 181332 - RNA, 1401 nt, Artificial Sequence
  derived and/or modified sequence opt4 from neuraminidase__InfluenzaB__ADR02756
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaucccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181333 - RNA, 1401 nt, Artificial Sequence
  derived and/or modified sequence opt4 from neuraminidase__InfluenzaB__AEA51353
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcggcgccuucaccgacaccuaccacagcuacgccaagaacauccugagcccccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181334 - RNA, 1401 nt, Artificial Sequence
  derived and/or modified sequence opt4 from neuraminidase__InfluenzaB__AEA51355
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacaccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaccuacggcgaggccuaccccggcaccuaccacagcuacgccaucaagaaccccagaacccaggagagcgcccccaacugcuucggcggccacagcuuccccaucaucacccacgccccccccagcggcgugugggagcccagauuccugaagaucagagagggcagaaucaucaacgagaucuuccccaccggcagagugaagccccccgaggagugcaccugcggcuucgccagcaacaacaccaucgagugcgccugcagagacaacaacugcaccgccaagagacccuucgugaaguuccacguggagagcgaccccgccgagaucagagccaugugcaccgacaccuaccuggacagccccagacccgacgacggcagcaucaccggccccugcgacagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccaacagcggcgugauggugagcaugaacgagcccggcagcagcagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181335 - RNA, 1401 nt, Artificial Sequence
  derived and/or modified sequence opt4 from neuraminidase__InfluenzaB__AEA51357
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguucggcgaggccuacaccgacaccuaccacagcuacgccaagaacauccugggcacccaggagagcgccugcaacugcaucggcggcgacugcaaccugaugaucaccgacggccccgccagcggcaucagcgagagcagauuccugaagaucggcgagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181336 - RNA, 1401 nt, Artificial Sequence
  derived and/or modified sequence opt4 from neuraminidase__InfluenzaB__AEA51359
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181337 - RNA, 1401 nt, Artificial Sequence
  derived and/or modified sequence opt4 from neuraminidase__InfluenzaB__AEA51365
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181338 - RNA, 1401 nt, Artificial Sequence; identical to SEQ ID NO: 181337
  derived and/or modified sequence opt4 from neuraminidase__InfluenzaB__AEA51367

SEQ ID NO: 181339 - RNA, 1401 nt, Artificial Sequence; identical to SEQ ID NO: 181337
  derived and/or modified sequence opt4 from neuraminidase__InfluenzaB__AEA51371

SEQ ID NO: 181340 - RNA, 1401 nt, Artificial Sequence
  derived and/or modified sequence opt4 from neuraminidase__InfluenzaB__AEA51373
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacaugacccuguga

SEQ ID NO: 181341 - RNA, 1401 nt, Artificial Sequence
  derived and/or modified sequence opt4 from neuraminidase__InfluenzaB__AEA51377
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181342 - RNA, 1401 nt, Artificial Sequence; identical to SEQ ID NO: 181341
  derived and/or modified sequence opt4 from neuraminidase__InfluenzaB__AEA51379

SEQ ID NO: 181343 - RNA, 1401 nt, Artificial Sequence
  derived and/or modified sequence opt4 from neuraminidase__InfluenzaB__AEA51381
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcgugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181344 - RNA, 1401 nt, Artificial Sequence; identical to SEQ ID NO: 181341
  derived and/or modified sequence opt4 from neuraminidase__InfluenzaB__AEA51383

SEQ ID NO: 181345 - RNA, 1401 nt, Artificial Sequence
  derived and/or modified sequence opt4 from neuraminidase__InfluenzaB__AEG20998
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccauccugagacuggccugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcggcgccuucaccgacaccuaccacagcuacgccaagaacauccugagcccccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181346 - RNA, 1401 nt, Artificial Sequence
  derived and/or modified sequence opt4 from neuraminidase__InfluenzaB__AEG20999
augcugcccagcaccauccagacccugacccuguuccugaccagcggcggcgugcugcugagccugagcgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcggcgccuucaccgacaccuaccacagcuacgccaagaacauccugagcccccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181347 - RNA, 1401 nt, Artificial Sequence
  derived and/or modified sequence opt4 from neuraminidase__InfluenzaB__AEG21000
augcugcccagcaccauccagacccugacccuguuccugaccagcggcggcgugcugcugagccuguacgugagcgccagccugagcuaccugcuguacagcgacauccugcugaaguucagcagaaccgagaucaccgccgccauccugauccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcggcgccuucaccgacaccuaccacagcuacgccaagaacauccugagcccccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181348 - RNA, 1401 nt, Artificial Sequence
  derived and/or modified sequence opt4 from neuraminidase__InfluenzaB__AEG21002
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugagacacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181349 - RNA, 1401 nt, Artificial Sequence
  derived and/or modified sequence opt4 from neuraminidase__InfluenzaB__AEG21003
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181350 - RNA, 1401 nt, Artificial Sequence
  derived and/or modified sequence opt4 from neuraminidase__InfluenzaB__AEG21004
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcggcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181351 - RNA, 1401 nt, Artificial Sequence
  derived and/or modified sequence opt4 from neuraminidase__InfluenzaB__AEG21005
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcggcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacaugacccuguga

SEQ ID NO: 181352 - RNA, 1401 nt, Artificial Sequence; identical to SEQ ID NO: 181337
  derived and/or modified sequence opt4 from neuraminidase__InfluenzaB__AEG21006

SEQ ID NO: 181353 - RNA, 1401 nt, Artificial Sequence; identical to SEQ ID NO: 181341
  derived and/or modified sequence opt4 from neuraminidase__InfluenzaB__AEG21007

SEQ ID NO: 181354 - RNA, 1401 nt, Artificial Sequence
  derived and/or modified sequence opt4 from neuraminidase__InfluenzaB__AEG21008
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181355 - RNA, 1401 nt, Artificial Sequence; identical to SEQ ID NO: 181341
  derived and/or modified sequence opt4 from neuraminidase__InfluenzaB__AEG21009

SEQ ID NO: 181356 - RNA, 1401 nt, Artificial Sequence; identical to SEQ ID NO: 181341
  derived and/or modified sequence opt4 from neuraminidase__InfluenzaB__AEG21010

SEQ ID NO: 181357 - RNA, 1401 nt, Artificial Sequence; identical to SEQ ID NO: 181341
  derived and/or modified sequence opt4 from neuraminidase__InfluenzaB__AEG21011

SEQ ID NO: 181358 - RNA, 1401 nt, Artificial Sequence; identical to SEQ ID NO: 181341
  derived and/or modified sequence opt4 from neuraminidase__InfluenzaB__AEG21012

SEQ ID NO: 181359 - RNA, 1401 nt, Artificial Sequence
  derived and/or modified sequence opt4 from neuraminidase__InfluenzaB__AEG21013
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181360 - RNA, 1401 nt, Artificial Sequence
  derived and/or modified sequence opt4 from neuraminidase__InfluenzaB__AEN68957
augcugcccagcaccauccagacccugacccuguuccugaccagcggcggcgugcugcugagccuguacgugagcgccagccugagcuaccugcuguacagcgacauccugcugaaguucagcagaaccgagauccccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagaugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaaguacaccgaggagugcaccugcggcuucgccagcaacaagaccaucggcugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugaugugggacaccgugaccggcgugaacaugacccuguga

SEQ ID NO: 181361 - RNA, 1401 nt, Artificial Sequence
  derived and/or modified sequence opt4 from neuraminidase__InfluenzaB__AEO80071
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181362 - RNA, 1401 nt, Artificial Sequence
  derived and/or modified sequence opt4 from neuraminidase__InfluenzaB__AEO80082
augcugcccagcaccauccagacccugacccuguuccugaccagcggcggcgugcugcugagccuguacgugagcgccagccugagcuaccugcuguacagcgacauccugcugaaguucagccagaccggcaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaaguacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181363 - RNA, 1401 nt, Artificial Sequence; identical to SEQ ID NO: 181202
  derived and/or modified sequence opt4 from neuraminidase__InfluenzaB__AEO80090

SEQ ID NO: 181364 - RNA, 1401 nt, Artificial Sequence; identical to SEQ ID NO: 181147
  derived and/or modified sequence opt4 from neuraminidase__InfluenzaB__AEO80101

SEQ ID NO: 181365 - RNA, 1401 nt, Artificial Sequence; identical to SEQ ID NO: 181243
  derived and/or modified sequence opt4 from neuraminidase__InfluenzaB__AEO80149

SEQ ID NO: 181366 - RNA, 1401 nt, Artificial Sequence; identical to SEQ ID NO: 181155
  derived and/or modified sequence opt4 from neuraminidase__InfluenzaB__AEO80158

SEQ ID NO: 181367 - RNA, 1401 nt, Artificial Sequence; identical to SEQ ID NO: 181155
  derived and/or modified sequence opt4 from neuraminidase__InfluenzaB__AEO80167

SEQ ID NO: 181368 - RNA, 1401 nt, Artificial Sequence; identical to SEQ ID NO: 181243
  derived and/or modified sequence opt4 from neuraminidase__InfluenzaB__AEO80176

SEQ ID NO: 181369 - RNA, 1401 nt, Artificial Sequence
  derived and/or modified sequence opt4 from neuraminidase__InfluenzaB__AEO80187
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccugggcugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacagaggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181370 - RNA, 1401 nt, Artificial Sequence
  derived and/or modified sequence opt4 from neuraminidase__InfluenzaB__AEO80198
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacagaggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181371 - RNA, 1401 nt, Artificial Sequence; identical to SEQ ID NO: 181311
  derived and/or modified sequence opt4 from neuraminidase__InfluenzaB__AEO80209

SEQ ID NO: 181372 - RNA, 1401 nt, Artificial Sequence
  derived and/or modified sequence opt4 from neuraminidase__InfluenzaB__AEO80220
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggccugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaccagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacagaggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181373 - RNA, 1401 nt, Artificial Sequence; identical to SEQ ID NO: 181308
  derived and/or modified sequence opt4 from neuraminidase__InfluenzaB__AEO80231

SEQ ID NO: 181374 - RNA, 1401 nt, Artificial Sequence; identical to SEQ ID NO: 181311
  derived and/or modified sequence opt4 from neuraminidase__InfluenzaB__AEO80242

SEQ ID NO: 181375 - RNA, 1401 nt, Artificial Sequence; identical to SEQ ID NO: 181155
  derived and/or modified sequence opt4 from neuraminidase__InfluenzaB__AEP20182

SEQ ID NO: 181376 - RNA, 1401 nt, Artificial Sequence
  derived and/or modified sequence opt4 from neuraminidase__InfluenzaB__AEP20193
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcgugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181377 - RNA, 1401 nt, Artificial Sequence
  derived and/or modified sequence opt4 from neuraminidase__InfluenzaB__AEP20204
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaucaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181378 - RNA, 1401 nt, Artificial Sequence; identical to SEQ ID NO: 181207
  derived and/or modified sequence opt4 from neuraminidase__InfluenzaB__AEP20215

SEQ ID NO: 181379 - RNA, 1401 nt, Artificial Sequence
  derived and/or modified sequence opt4 from neuraminidase__InfluenzaB__AEP20237
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacgccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181380 - RNA, 1401 nt, Artificial Sequence; identical to SEQ ID NO: 181207
  derived and/or modified sequence opt4 from neuraminidase__InfluenzaB__AEP20248

SEQ ID NO: 181381 - RNA, 1401 nt, Artificial Sequence
  derived and/or modified sequence opt4 from neuraminidase__InfluenzaB__AEP20259
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaucaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181382 - RNA, 1401 nt, Artificial Sequence
  derived and/or modified sequence opt4 from neuraminidase__InfluenzaB__AEP20281
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcaccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181383 - RNA, 1401 nt, Artificial Sequence; identical to SEQ ID NO: 181155
  derived and/or modified sequence opt4 from neuraminidase__InfluenzaB__AEP20292

SEQ ID NO: 181384 - RNA, 1401 nt, Artificial Sequence; identical to SEQ ID NO: 181147
  derived and/or modified sequence opt4 from neuraminidase__InfluenzaB__AEP20303

SEQ ID NO: 181385 - RNA, 1401 nt, Artificial Sequence
  derived and/or modified sequence opt4 from neuraminidase__InfluenzaB__AEP20314
augcugcccagcaccauccagacccugacccuguuccugaccagcggcggcgugcugcugagccuguacgugagcgccagccugagcuaccugcuguacagcgacauccugcugaaguucagccagaccggcaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugaugaucagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181386 - RNA, 1401 nt, Artificial Sequence
  derived and/or modified sequence opt4 from neuraminidase__InfluenzaB__AEP20336
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugacccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccagcaucuacugccugaugggcagcggccagcugcugugggacaccgugaccggcguggacauggcccuguga

SEQ ID NO: 181387 - RNA, 1401 nt, Artificial Sequence
  derived and/or modified sequence opt4 from neuraminidase__InfluenzaB__AEP20347
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugcccauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181388 - RNA, 1401 nt, Artificial Sequence; identical to SEQ ID NO: 181387
  derived and/or modified sequence opt4 from neuraminidase__InfluenzaB__AEP20358

SEQ ID NO: 181389 - RNA, 1401 nt, Artificial Sequence; identical to SEQ ID NO: 181387
  derived and/or modified sequence opt4 from neuraminidase__InfluenzaB__AEP20369

SEQ ID NO: 181390 - RNA, 1401 nt, Artificial Sequence; identical to SEQ ID NO: 181387
  derived and/or modified sequence opt4 from neuraminidase__InfluenzaB__AEP20380

SEQ ID NO: 181391 - RNA, 1401 nt, Artificial Sequence
  derived and/or modified sequence opt4 from neuraminidase__InfluenzaB__AEP20391
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacagacugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaaggugggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181392 - RNA, 1401 nt, Artificial Sequence
  derived and/or modified sequence opt4 from neuraminidase__InfluenzaB__AEP20413
augcugcccagcaccauccagacccugacccuguuccugaccagcggcggcgugcugcugagccuguacgugagcgcccugcugagcuaccugcuguacagcgacauccugcugaaguucagccccaccgagaucaucgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacaacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181393 - RNA, 1401 nt, Artificial Sequence; identical to SEQ ID NO: 181392
  derived and/or modified sequence opt4 from neuraminidase__InfluenzaB__AEP20435

SEQ ID NO: 181394 - RNA, 1401 nt, Artificial Sequence; identical to SEQ ID NO: 181387
  derived and/or modified sequence opt4 from neuraminidase__InfluenzaB__AEQ39031

SEQ ID NO: 181395 - RNA, 1401 nt, Artificial Sequence
  derived and/or modified sequence opt4 from neuraminidase__InfluenzaB__AEQ39275
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181396 - RNA, 1401 nt, Artificial Sequence; identical to SEQ ID NO: 181395
  derived and/or modified sequence opt4 from neuraminidase__InfluenzaB__AEQ39286

SEQ ID NO: 181397 - RNA, 1401 nt, Artificial Sequence; identical to SEQ ID NO: 181395
  derived and/or modified sequence opt4 from neuraminidase__InfluenzaB__AEQ39297

SEQ ID NO: 181398 - RNA, 1401 nt, Artificial Sequence; identical to SEQ ID NO: 181395
  derived and/or modified sequence opt4 from neuraminidase__InfluenzaB__AEQ39308

SEQ ID NO: 181399 - RNA, 1401 nt, Artificial Sequence; identical to SEQ ID NO: 181395
  derived and/or modified sequence opt4 from neuraminidase__InfluenzaB__AEQ39319

SEQ ID NO: 181400 - RNA, 1401 nt, Artificial Sequence
  derived and/or modified sequence opt4 from neuraminidase__InfluenzaB__AEQ39330
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacaucgcccuguga

SEQ ID NO: 181401 - RNA, 1401 nt, Artificial Sequence; identical to SEQ ID NO: 181395
  derived and/or modified sequence opt4 from neuraminidase__InfluenzaB__AEQ39341

SEQ ID NO: 181402 - RNA, 1401 nt, Artificial Sequence; identical to SEQ ID NO: 181395
  derived and/or modified sequence opt4 from neuraminidase__InfluenzaB__AEQ39352

SEQ ID NO: 181403 - RNA, 1401 nt, Artificial Sequence; identical to SEQ ID NO: 181395
  derived and/or modified sequence opt4 from neuraminidase__InfluenzaB__AEQ39363

SEQ ID NO: 181404 - RNA, 1401 nt, Artificial Sequence; identical to SEQ ID NO: 181361
  derived and/or modified sequence opt4 from neuraminidase__InfluenzaB__AEQ39374

SEQ ID NO: 181405 - RNA, 1401 nt, Artificial Sequence
  derived and/or modified sequence opt4 from neuraminidase__InfluenzaB__AEQ39385
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaaugaccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181406 - RNA, 1401 nt, Artificial Sequence
  derived and/or modified sequence opt4 from neuraminidase__InfluenzaB__AEQ39444
augcugcccagcaccauccagacccugacccuguuccugaccagcggcggcgugcugcugagccuguacgugagcgccagccugagcuaccugcuguacagcgacauccugcugaaguucagccagaccgagaucaucgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181407 - RNA, 1401 nt, Artificial Sequence; identical to SEQ ID NO: 181308
  derived and/or modified sequence opt4 from neuraminidase__InfluenzaB__AEQ39455

SEQ ID NO: 181408 - RNA, 1401 nt, Artificial Sequence
  derived and/or modified sequence opt4 from neuraminidase__InfluenzaB__AEQ39466
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaaggugggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181409 - RNA, 1401 nt, Artificial Sequence; identical to SEQ ID NO: 181395
  derived and/or modified sequence opt4 from neuraminidase__InfluenzaB__AEQ39477

SEQ ID NO: 181410 - RNA, 1401 nt, Artificial Sequence
  derived and/or modified sequence opt4 from neuraminidase__InfluenzaB__AEQ39488
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcagaaucggcagaugguacagcagaaccaugagcaagaccgagagaaugggcaugggccuguacgugaaguacgacggcgaccccuggaccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181411 - RNA, 1401 nt, Artificial Sequence; identical to SEQ ID NO: 181361
  derived and/or modified sequence opt4 from neuraminidase__InfluenzaB__AEQ39499

SEQ ID NO: 181412 - RNA, 1401 nt, Artificial Sequence; identical to SEQ ID NO: 181207
  derived and/or modified sequence opt4 from neuraminidase__InfluenzaB__AEQ39510

SEQ ID NO: 181413 - RNA, 1401 nt, Artificial Sequence
  derived and/or modified sequence opt4 from neuraminidase__InfluenzaB__AEQ49685
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggaccuguga

SEQ ID NO: 181414 - RNA, 1401 nt, Artificial Sequence
  derived and/or modified sequence opt4 from neuraminidase__InfluenzaB__AEQ49686
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181415 - RNA, 1401 nt, Artificial Sequence
  derived and/or modified sequence opt4 from neuraminidase__InfluenzaB__AEQ49687
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181416 - RNA, 1401 nt, Artificial Sequence
  derived and/or modified sequence opt4 from neuraminidase__InfluenzaB__AEQ49688
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccugggcugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181417 - RNA, 1401 nt, Artificial Sequence
  derived and/or modified sequence opt4 from neuraminidase__InfluenzaB__AEQ49691
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacagaggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181418 - RNA, 1401 nt, Artificial Sequence
  derived and/or modified sequence opt4 from neuraminidase__InfluenzaB__AEQ49692
augcugcccagcaccauccagacccugacccuguuccugaccagcggcggcgugcugcugagccuguacgugagcgccagccugagcuaccugcuguacagcgacauccugcugaaguucagccccaccgagaccaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181419 - RNA, 1401 nt, Artificial Sequence
  derived and/or modified sequence opt4 from neuraminidase__InfluenzaB__AEQ49693
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacagaaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181420 - RNA, 1401 nt, Artificial Sequence
  derived and/or modified sequence opt4 from neuraminidase__InfluenzaB__AEQ49695
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181421 - RNA, 1401 nt, Artificial Sequence
  derived and/or modified sequence opt4 from neuraminidase__InfluenzaB__AEQ49697
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181422 - RNA, 1401 nt, Artificial Sequence; identical to SEQ ID NO: 181421
  derived and/or modified sequence opt4 from neuraminidase__InfluenzaB__AEQ49698

SEQ ID NO: 181423 - RNA, 1401 nt, Artificial Sequence; identical to SEQ ID NO: 181421
  derived and/or modified sequence opt4 from neuraminidase__InfluenzaB__AEQ49699

SEQ ID NO: 181424 - RNA, 1401 nt, Artificial Sequence; identical to SEQ ID NO: 181421
  derived and/or modified sequence opt4 from neuraminidase__InfluenzaB__AEQ49700

SEQ ID NO: 181425 - RNA, 1401 nt, Artificial Sequence; identical to SEQ ID NO: 181418
  derived and/or modified sequence opt4 from neuraminidase__InfluenzaB__AEQ49701

SEQ ID NO: 181426 - RNA, 1401 nt, Artificial Sequence; identical to SEQ ID NO: 181421
  derived and/or modified sequence opt4 from neuraminidase__InfluenzaB__AEQ49702

SEQ ID NO: 181427 - RNA, 1401 nt, Artificial Sequence; identical to SEQ ID NO: 181418
  derived and/or modified sequence opt4 from neuraminidase__InfluenzaB__AEQ49703

SEQ ID NO: 181428 - RNA, 1401 nt, Artificial Sequence; identical to SEQ ID NO: 181421
  derived and/or modified sequence opt4 from neuraminidase__InfluenzaB__AEQ49705

SEQ ID NO: 181429 - RNA, 1401 nt, Artificial Sequence
  derived and/or modified sequence opt4 from neuraminidase__InfluenzaB__AEQ49706
augcugcccagcaccauccagaugcugacccuguuccugacccugggcggcgugcugcugagccuguacgugagcgccagccugagcuaccugcuguaccuggacauccugcugaaguucccccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuucaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181430 - RNA, 1401 nt, Artificial Sequence; identical to SEQ ID NO: 181421
  derived and/or modified sequence opt4 from neuraminidase__InfluenzaB__AEQ49707

SEQ ID NO: 181431 - RNA, 1401 nt, Artificial Sequence; identical to SEQ ID NO: 181421
  derived and/or modified sequence opt4 from neuraminidase__InfluenzaB__AEQ49708

SEQ ID NO: 181432 - RNA, 1401 nt, Artificial Sequence
  derived and/or modified sequence opt4 from neuraminidase__InfluenzaB__AEQ49709
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccaccugcugugggacaccgugaccggcguggacauggcccuguga

SEQ ID NO: 181433 - RNA, 1401 nt, Artificial Sequence; identical to SEQ ID NO: 181395
  derived and/or modified sequence opt4 from neuraminidase__InfluenzaB__AEQ49710

SEQ ID NO: 181434 - RNA, 1401 nt, Artificial Sequence; identical to SEQ ID NO: 181392
  derived and/or modified sequence opt4 from neuraminidase__InfluenzaB__AER27042

SEQ ID NO: 181435 - RNA, 1401 nt, Artificial Sequence; identical to SEQ ID NO: 181420
  derived and/or modified sequence opt4 from neuraminidase__InfluenzaB__AER27053

SEQ ID NO: 181436 - RNA, 1401 nt, Artificial Sequence; identical to SEQ ID NO: 181392
  derived and/or modified sequence opt4 from neuraminidase__InfluenzaB__AER27064

SEQ ID NO: 181437 - RNA, 1401 nt, Artificial Sequence; identical to SEQ ID NO: 181395
  derived and/or modified sequence opt4 from neuraminidase__InfluenzaB__AET43128

SEQ ID NO: 181438 - RNA, 1401 nt, Artificial Sequence; identical to SEQ ID NO: 181395
  derived and/or modified sequence opt4 from neuraminidase__InfluenzaB__AET43139

SEQ ID NO: 181439 - RNA, 1401 nt, Artificial Sequence
  derived and/or modified sequence opt4 from neuraminidase__InfluenzaB__AET43150
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181440 - RNA, 1401 nt, Artificial Sequence; identical to SEQ ID NO: 181395
  derived and/or modified sequence opt4 from neuraminidase__InfluenzaB__AET43161

SEQ ID NO: 181441 - RNA, 1401 nt, Artificial Sequence; identical to SEQ ID NO: 181395
  derived and/or modified sequence opt4 from neuraminidase__InfluenzaB__AET43172

SEQ ID NO: 181442 - RNA, 1401 nt, Artificial Sequence; identical to SEQ ID NO: 181395
  derived and/or modified sequence opt4 from neuraminidase__InfluenzaB__AET43183

SEQ ID NO: 181443 - RNA, 1401 nt, Artificial Sequence; identical to SEQ ID NO: 181395
  derived and/or modified sequence opt4 from neuraminidase__InfluenzaB__AET43194

SEQ ID NO: 181444 - RNA, 1401 nt, Artificial Sequence; identical to SEQ ID NO: 181395
  derived and/or modified sequence opt4 from neuraminidase__InfluenzaB__AET43216

SEQ ID NO: 181445 - RNA, 1401 nt, Artificial Sequence; identical to SEQ ID NO: 181395
  derived and/or modified sequence opt4 from neuraminidase__InfluenzaB__AET43227

SEQ ID NO: 181446 - RNA, 1401 nt, Artificial Sequence
  derived and/or modified sequence opt4 from neuraminidase__InfluenzaB__AET50947
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugaugaucagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181447 - RNA, 1401 nt, Artificial Sequence
  derived and/or modified sequence opt4 from neuraminidase__InfluenzaB__AET50958
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccuggacugcgccaacgccagcaacgugcaggccgugaaccacagcgccaccaagggcgugacccugcugcugcccgagcuggaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181448 - RNA, 1401 nt, Artificial Sequence; identical to SEQ ID NO: 181395
  derived and/or modified sequence opt4 from neuraminidase__InfluenzaB__AET50969

SEQ ID NO: 181449 - RNA, 1401 nt, Artificial Sequence; identical to SEQ ID NO: 181395
  derived and/or modified sequence opt4 from neuraminidase__InfluenzaB__AET50980

SEQ ID NO: 181450 - RNA, 1401 nt, Artificial Sequence; identical to SEQ ID NO: 181395
  derived and/or modified sequence opt4 from neuraminidase__InfluenzaB__AET74259

SEQ ID NO: 181451 - RNA, 1401 nt, Artificial Sequence; identical to SEQ ID NO: 181395
  derived and/or modified sequence opt4 from neuraminidase__InfluenzaB__AET74270

SEQ ID NO: 181452 - RNA, 1401 nt, Artificial Sequence; identical to SEQ ID NO: 181446
  derived and/or modified sequence opt4 from neuraminidase__InfluenzaB__AET74281

SEQ ID NO: 181453 - RNA, 1401 nt, Artificial Sequence; identical to SEQ ID NO: 181395
  derived and/or modified sequence opt4 from neuraminidase__InfluenzaB__AET74292

SEQ ID NO: 181454 - RNA, 1401 nt, Artificial Sequence; identical to SEQ ID NO: 181395
  derived and/or modified sequence opt4 from neuraminidase__InfluenzaB__AET74303

SEQ ID NO: 181455 - RNA, 1401 nt, Artificial Sequence; identical to SEQ ID NO: 181395
  derived and/or modified sequence opt4 from neuraminidase__InfluenzaB__AET74314

SEQ ID NO: 181456 - RNA, 1401 nt, Artificial Sequence; identical to SEQ ID NO: 181395
  derived and/or modified sequence opt4 from neuraminidase__InfluenzaB__AET74333

SEQ ID NO: 181457 - RNA, 1401 nt, Artificial Sequence
  derived and/or modified sequence opt4 from neuraminidase__InfluenzaB__AET74344
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggaggccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181458 - RNA, 1401 nt, Artificial Sequence; identical to SEQ ID NO: 181395
  derived and/or modified sequence opt4 from neuraminidase__InfluenzaB__AET74355

SEQ ID NO: 181459 - RNA, 1404 nt, Artificial Sequence
  derived and/or modified sequence opt4 from neuraminidase__InfluenzaB__AEY75594
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaccaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181460 - RNA, 1401 nt, Artificial Sequence
  derived and/or modified sequence opt4 from neuraminidase__InfluenzaB__AFA45223
augcugcccagcaccauccagacccugacccuguuccugaccagcggcggcgugcugcugagccuguacgugagcgcccugcugagcuaccugcuguacagcgacauccugcccaaguucagccccaccgagaucaccgcccccaccaugagccuggacugcgccaacgccagcaacgugcaggccgugaacagaagcgccaccaagggcgugaccuuccugcugagcgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181461 - RNA, 1401 nt, Artificial Sequence
  derived and/or modified sequence opt4 from neuraminidase__InfluenzaB__AFA45226
augcugcccagcaccauccagacccugacccuguuccugaccagcggcggcgugcugcugagccuguacgugagcgccagccugagcuaccugcuguacagcgacauccugcugaaguucagccccaccgagaccaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaaggugcccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaagggcaccuggcacagcgccgccaccgccaucuacugccugaugggcagcggccagcugcugugggacaccgugaccggcguggacauggcccuguga

SEQ ID NO: 181462 - RNA, 1401 nt, Artificial Sequence
  derived and/or modified sequence opt4 from neuraminidase__InfluenzaB__AFA45229
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181463 - RNA, 1401 nt, Artificial Sequence; identical to SEQ ID NO: 181415
  derived and/or modified sequence opt4 from neuraminidase__InfluenzaB__AFA45235

SEQ ID NO: 181464 - RNA, 1401 nt, Artificial Sequence
  derived and/or modified sequence opt4 from neuraminidase__InfluenzaB__AFA45238
augcugcccagcaccauccagacccugacccuguuccugaccagcggcggcgugcugcugagccuguacgugagcgccagccugagcuaccugcuguacagcgacauccugcugaaguucagccccaccaagaccaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181465 - RNA, 1401 nt, Artificial Sequence
  derived and/or modified sequence opt4 from neuraminidase__InfluenzaB__AFA45241
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaucuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181466 - RNA, 1401 nt, Artificial Sequence
  derived and/or modified sequence opt4 from neuraminidase__InfluenzaB__AFA45244
augcugcccagcaccauccagacccugacccuguuccugaccagcggcggcgugcugcugagccuguacgugagcgccagccugagcuaccugcuguacagcgacauccugcugaaguucagccccaccgagaccaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181467 - RNA, 1401 nt, Artificial Sequence
  derived and/or modified sequence opt4 from neuraminidase__InfluenzaB__AFA45247
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181468 - RNA, 1401 nt, Artificial Sequence; identical to SEQ ID NO: 181418
  derived and/or modified sequence opt4 from neuraminidase__InfluenzaB__AFA45250

SEQ ID NO: 181469 - RNA, 1401 nt, Artificial Sequence
  derived and/or modified sequence opt4 from neuraminidase__InfluenzaB__AFA45253
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgugugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181470 - RNA, 1401 nt, Artificial Sequence
  derived and/or modified sequence opt4 from neuraminidase__InfluenzaB__AFB77645
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181471 - RNA, 1401 nt, Artificial Sequence
  derived and/or modified sequence opt4 from neuraminidase__InfluenzaB__AFB77647
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaucccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181472 - RNA, 1401 nt, Artificial Sequence
  derived and/or modified sequence opt4 from neuraminidase__InfluenzaB__AFB77649
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181473 - RNA, 1401 nt, Artificial Sequence
  derived and/or modified sequence opt4 from neuraminidase__InfluenzaB__AFB77651
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaccagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181474 - RNA, 1401 nt, Artificial Sequence
  derived and/or modified sequence opt4 from neuraminidase__InfluenzaB__AFE00364
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacagacugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181475 - RNA, 1401 nt, Artificial Sequence
  derived and/or modified sequence opt4 from neuraminidase__InfluenzaB__AFF18536
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcagacacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucagaggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181476 - RNA, 1401 nt, Artificial Sequence
  derived and/or modified sequence opt4 from neuraminidase__InfluenzaB__AFF18545
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181477 - RNA, 1401 nt, Artificial Sequence; identical to SEQ ID NO: 181337
  derived and/or modified sequence opt4 from neuraminidase__InfluenzaB__AFH34933

SEQ ID NO: 181478 - RNA, 1401 nt, Artificial Sequence; identical to SEQ ID NO: 181337
  derived and/or modified sequence opt4 from neuraminidase__InfluenzaB__AFH34939

SEQ ID NO: 181479 - RNA, 1401 nt, Artificial Sequence; identical to SEQ ID NO: 181275
  derived and/or modified sequence opt4 from neuraminidase__InfluenzaB__AFH57869

SEQ ID NO: 181480 - RNA, 1401 nt, Artificial Sequence
  derived and/or modified sequence opt4 from neuraminidase__InfluenzaB__AFH57891
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacuacgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181481 - RNA, 1401 nt, Artificial Sequence
  derived and/or modified sequence opt4 from neuraminidase__InfluenzaB__AFH57913
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181482 - RNA, 1401 nt, Artificial Sequence; identical to SEQ ID NO: 181337
  derived and/or modified sequence opt4 from neuraminidase__InfluenzaB__AFH57935

SEQ ID NO: 181483 - RNA, 1401 nt, Artificial Sequence; identical to SEQ ID NO: 181337
  derived and/or modified sequence opt4 from neuraminidase__InfluenzaB__AFH57946

SEQ ID NO: 181484 - RNA, 1401 nt, Artificial Sequence; identical to SEQ ID NO: 181337
  derived and/or modified sequence opt4 from neuraminidase__InfluenzaB__AFH57957

SEQ ID NO: 181485 - RNA, 1401 nt, Artificial Sequence; identical to SEQ ID NO: 181415
  derived and/or modified sequence opt4 from neuraminidase__InfluenzaB__AFH57968

SEQ ID NO: 181486 - RNA, 1401 nt, Artificial Sequence
  derived and/or modified sequence opt4 from neuraminidase__InfluenzaB__AFH57979
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaucuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181487 - RNA, 1401 nt, Artificial Sequence; identical to SEQ ID NO: 181104
  derived and/or modified sequence opt4 from neuraminidase__InfluenzaB__AFH58253

SEQ ID NO: 181488 - RNA, 1401 nt, Artificial Sequence; identical to SEQ ID NO: 181167
  derived and/or modified sequence opt4 from neuraminidase__InfluenzaB__AFH58264

SEQ ID NO: 181489 - RNA, 1401 nt, Artificial Sequence; identical to SEQ ID NO: 181308
  derived and/or modified sequence opt4 from neuraminidase__InfluenzaB__AFH58275

SEQ ID NO: 181490 - RNA, 1401 nt, Artificial Sequence; identical to SEQ ID NO: 181308
  derived and/or modified sequence opt4 from neuraminidase__InfluenzaB__AFH58286

SEQ ID NO: 181491 - RNA, 1401 nt, Artificial Sequence; identical to SEQ ID NO: 181481
  derived and/or modified sequence opt4 from neuraminidase__InfluenzaB__AFH58297

SEQ ID NO: 181492 - RNA, 1401 nt, Artificial Sequence
  derived and/or modified sequence opt4 from neuraminidase__InfluenzaB__AFH58308
augcugcccagcaccauccagacccugacccuguuccugaccagcggcggcgugcugcugagccuguacgugagcgccagccugagcuaccugcuguacagcgacauccugcugaaguucagcagaaccgagaccaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181493 - RNA, 1401 nt, Artificial Sequence; identical to SEQ ID NO: 181492
  derived and/or modified sequence opt4 from neuraminidase__InfluenzaB__AFH58319

SEQ ID NO: 181494 - RNA, 1401 nt, Artificial Sequence
  derived and/or modified sequence opt4 from neuraminidase__InfluenzaB__AFH58341
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugagacugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181495 - RNA, 1401 nt, Artificial Sequence
  derived and/or modified sequence opt4 from neuraminidase__InfluenzaB__AFH58363
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181496 - RNA, 1401 nt, Artificial Sequence; identical to SEQ ID NO: 181495
  derived and/or modified sequence opt4 from neuraminidase__InfluenzaB__AFH58374

SEQ ID NO: 181497 - RNA, 1401 nt, Artificial Sequence; identical to SEQ ID NO: 181481
  derived and/or modified sequence opt4 from neuraminidase__InfluenzaB__AFH58385

SEQ ID NO: 181498 - RNA, 1401 nt, Artificial Sequence; identical to SEQ ID NO: 181481
  derived and/or modified sequence opt4 from neuraminidase__InfluenzaB__AFH58396

SEQ ID NO: 181499 - RNA, 1401 nt, Artificial Sequence; identical to SEQ ID NO: 181481
  derived and/or modified sequence opt4 from neuraminidase__InfluenzaB__AFH58407

SEQ ID NO: 181500 - RNA, 1401 nt, Artificial Sequence; identical to SEQ ID NO: 181481
  derived and/or modified sequence opt4 from neuraminidase__InfluenzaB__AFH58418

SEQ ID NO: 181501 - RNA, 1401 nt, Artificial Sequence
  derived and/or modified sequence opt4 from neuraminidase__InfluenzaB__AFH58429
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacgagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181502 - RNA, 1401 nt, Artificial Sequence
  derived and/or modified sequence opt4 from neuraminidase__InfluenzaB__AFH58440
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagauccaggagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181503 - RNA, 1401 nt, Artificial Sequence
  derived and/or modified sequence opt4 from neuraminidase__InfluenzaB__AFH58462
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacgagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacaugacccuguga

SEQ ID NO: 181504 - RNA, 1401 nt, Artificial Sequence; identical to SEQ ID NO: 181503
  derived and/or modified sequence opt4 from neuraminidase__InfluenzaB__AFH58473

SEQ ID NO: 181505 - RNA, 1401 nt, Artificial Sequence; identical to SEQ ID NO: 181337
  derived and/or modified sequence opt4 from neuraminidase__InfluenzaB__AFH58484

SEQ ID NO: 181506 - RNA, 1401 nt, Artificial Sequence; identical to SEQ ID NO: 181337
  derived and/or modified sequence opt4 from neuraminidase__InfluenzaB__AFH58495

SEQ ID NO: 181507 - RNA, 1401 nt, Artificial Sequence; identical to SEQ ID NO: 181337
  derived and/or modified sequence opt4 from neuraminidase__InfluenzaB__AFH58506

SEQ ID NO: 181508 - RNA, 1401 nt, Artificial Sequence
  derived and/or modified sequence opt4 from neuraminidase__InfluenzaB__AFH58517
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggcagacugcugugggacaccgugaccggcguggacauggcccuguga

SEQ ID NO: 181509 - RNA, 1401 nt, Artificial Sequence; identical to SEQ ID NO: 181415
  derived and/or modified sequence opt4 from neuraminidase__InfluenzaB__AFH58528

SEQ ID NO: 181510 - RNA, 1401 nt, Artificial Sequence
  derived and/or modified sequence opt4 from neuraminidase__InfluenzaB__AFH58539
augcugcccagcaccgugcagacccugacccugcugcugaccagcggcggcgugcugcugagccuguacgugagcgccagccugagcuaccugcuguacagcgacgugcugcugaaguucagcagcaccaagaccaccgcccccaccaugagccuggagugcaccaacgccagcaacgcccagaccgugaaccacagcgccaccaaggagaugaccuuccccccccccgagcccgaguggaccuaccccagacugagcugccagggcagcaccuuccagaaggcccugcugaucagcccccacagauucggcgagaucaagggcaacagcgccccccugaucaucagagagcccuucguggccugcggccccaaggagugcagacacuucgcccugacccacuacgccgcccagcccggcggcuacuacaacggcaccagaaaggacagaaacaagcugagacaccuggugagcgugaagcugggcaagauccccaccguggagaacagcaucuuccacauggccgccuggagcggcagcgccugccacgacggcagagaguggaccuacaucggcguggacggccccgacaacgacgcccuggugaagaucaaguacggcgaggccuacaccgacaccuaccacagcuacgcccacaacauccugagaacccaggagagcgccugcaacugcaucggcggcgacugcuaccugaugaucaccgacggcagcgccagcggcaucagcaagugcagauuccugaagaucagagagggcagaaucaucaaggagauccugcccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucgccggccccugcgagagcaacggcgacaaguggcugggcggcaucaagggcggcuucgugcaccagagaauggccagcaagaucggcagaugguacagcagaaccaugagcaagaccaacagaaugggcauggagcuguacgugaaguacgacggcgaccccuggaccgacagcgacgcccugacccugagcggcgugauggugagcaucgaggagcccggcugguacagcuucggcuucgagaucaaggacaagaagugcgacgugcccugcaucggcaucgagauggugcacgacggcggcaaggacaccuggcacagcgccgccaccgccaucuacugccugaugggcagcggccagcugcugugggacaccgccaccggcguggacauggcccuguga

SEQ ID NO: 181511 - RNA, 1401 nt, Artificial Sequence
  derived and/or modified sequence opt4 from neuraminidase__InfluenzaB__AFH58550
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaaggagaugacccugcugcugcccgagcccgaguggaccuaccccagacugagcugccccggcagcaccuuccagaaggcccugcugaucagcccccacagauucggcgagaccagaggcaacagcgccccccugaccaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccgagagaaugggcauggagcuguacgugaaguacgacggcgaccccuggaccgacagcgaggcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181512 - RNA, 1401 nt, Artificial Sequence; identical to SEQ ID NO: 181511
  derived and/or modified sequence opt4 from neuraminidase__InfluenzaB__AFH58561

SEQ ID NO: 181513 - RNA, 1401 nt, Artificial Sequence
  derived and/or modified sequence opt4 from neuraminidase__InfluenzaB__AFJ69969
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccuggaccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181514 - RNA, 1401 nt, Artificial Sequence; identical to SEQ ID NO: 181476
  derived and/or modified sequence opt4 from neuraminidase__InfluenzaB__AFJ69971

SEQ ID NO: 181515 - RNA, 1401 nt, Artificial Sequence
  derived and/or modified sequence opt4 from neuraminidase__InfluenzaB__AFJ69973
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgccugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181516 - RNA, 1401 nt, Artificial Sequence; identical to SEQ ID NO: 181337
  derived and/or modified sequence opt4 from neuraminidase__InfluenzaB__AFJ69975

SEQ ID NO: 181517 - RNA, 1401 nt, Artificial Sequence
  derived and/or modified sequence opt4 from neuraminidase__InfluenzaB__AFJ69979
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacaccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181518 - RNA, 1401 nt, Artificial Sequence; identical to SEQ ID NO: 181476
  derived and/or modified sequence opt4 from neuraminidase__InfluenzaB__AFJ69981

SEQ ID NO: 181519 - RNA, 1401 nt, Artificial Sequence
  derived and/or modified sequence opt4 from neuraminidase__InfluenzaB__AFJ69983
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagauccugcccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181520 - RNA, 1401 nt, Artificial Sequence
  derived and/or modified sequence opt4 from neuraminidase__InfluenzaB__AFJ69987
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaccaagggcggcuucgugcaccagagaaugaagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181521 - RNA, 1401 nt, Artificial Sequence
  derived and/or modified sequence opt4 from neuraminidase__InfluenzaB__AFJ76228
augcugcccagcaccauccagacccugacccuguuccugaccagcggcggcgugcugcugagccuguacgugagcgccagccugagcuaccugcuguacagcggcauccugcugaaguucagccccaccgagaucaccgcccccaccaugccccugaacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181522 - RNA, 1401 nt, Artificial Sequence; identical to SEQ ID NO: 181188
  derived and/or modified sequence opt4 from neuraminidase__InfluenzaB__AFJ76261

SEQ ID NO: 181523 - RNA, 1401 nt, Artificial Sequence
  derived and/or modified sequence opt4 from neuraminidase__InfluenzaB__AFJ76283
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181524 - RNA, 1401 nt, Artificial Sequence
  derived and/or modified sequence opt4 from neuraminidase__InfluenzaB__AFJ76305
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagagagcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181525 - RNA, 1401 nt, Artificial Sequence
  derived and/or modified sequence opt4 from neuraminidase__InfluenzaB__AFJ76316
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181526 - RNA, 1401 nt, Artificial Sequence; identical to SEQ ID NO: 181188
  derived and/or modified sequence opt4 from neuraminidase__InfluenzaB__AFJ76338

SEQ ID NO: 181527 - RNA, 1401 nt, Artificial Sequence
  derived and/or modified sequence opt4 from neuraminidase__InfluenzaB__AFJ77331
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccuacaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181528 - RNA, 1401 nt, Artificial Sequence; identical to SEQ ID NO: 181263
  derived and/or modified sequence opt4 from neuraminidase__InfluenzaB__AFJ77351

SEQ ID NO: 181529 - RNA, 1401 nt, Artificial Sequence; identical to SEQ ID NO: 181155
  derived and/or modified sequence opt4 from neuraminidase__InfluenzaB__AFJ77362

SEQ ID NO: 181530 - RNA, 1401 nt, Artificial Sequence; identical to SEQ ID NO: 181308
  derived and/or modified sequence opt4 from neuraminidase__InfluenzaB__AFJ77384

SEQ ID NO: 181531 - RNA, 1401 nt, Artificial Sequence; identical to SEQ ID NO: 181230
  derived and/or modified sequence opt4 from neuraminidase__InfluenzaB__AFJ80132

SEQ ID NO: 181532 - RNA, 1401 nt, Artificial Sequence
  derived and/or modified sequence opt4 from neuraminidase__InfluenzaB__AFJ80143
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181533 - RNA, 1401 nt, Artificial Sequence
  derived and/or modified sequence opt4 from neuraminidase__InfluenzaB__AFJ80154
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggccauccugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181534 - RNA, 1401 nt, Artificial Sequence
  derived and/or modified sequence opt4 from neuraminidase__InfluenzaB__AFJ80165
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaucccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacauccccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181535 - RNA, 1401 nt, Artificial Sequence
  derived and/or modified sequence opt4 from neuraminidase__InfluenzaB__AFJ80176
augcugcccagcaccauccagacccugacccuguuccugaccagcggcggcgugcugcugagccuguacgugagcgccagccugagcuaccugcuguacagcgacauccugcugaaguucagccccaccgagaucaccgugcccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181536 - RNA, 1401 nt, Artificial Sequence
  derived and/or modified sequence opt4 from neuraminidase__InfluenzaB__AFJ80187
augcugcccagcaccauccagacccugacccuguuccugaccagcggcggcgugcugcugagccuguacgugagcgccagccugagcuaccugcuguacagcggcauccugcugaaguucagccccaccgagaucaccgcccccaccaugccccugaacugcgccaacgccagcaacuuccaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181537 - RNA, 1401 nt, Artificial Sequence; identical to SEQ ID NO: 181532
  derived and/or modified sequence opt4 from neuraminidase__InfluenzaB__AFJ80198

SEQ ID NO: 181538 - RNA, 1401 nt, Artificial Sequence; identical to SEQ ID NO: 181160
  derived and/or modified sequence opt4 from neuraminidase__InfluenzaB__AFJ80220

SEQ ID NO: 181539 - RNA, 1401 nt, Artificial Sequence
  derived and/or modified sequence opt4 from neuraminidase__InfluenzaB__AFJ80231
augcugcccagcaccauccagacccugacccuguuccugaccagcggcggcgugcugcugagccuguacgugagcgccagccugagcuaccugcuguacagcggcauccugcugaaguucagccugaccgagaucaccgcccccaccaugccccugaacugcgccaacgccagcaacgugcaggccgugaacagaagcgccaccaagggcgugacccuguuccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcguggagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181540 - RNA, 1401 nt, Artificial Sequence
  derived and/or modified sequence opt4 from neuraminidase__InfluenzaB__AFJ80242
augcugcccagcaccauccagacccugacccuguuccugaccagcggcggcgugcugcugagccuguacgugagcgcccugcugagcuaccugcuguacagcgacauccugcugaaguucagccccaccaaggugaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcagaugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcaacggcggcaucaagggcggcuucgugcaccagagaauggccagcagaaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181541 - RNA, 1401 nt, Artificial Sequence
  derived and/or modified sequence opt4 from neuraminidase__InfluenzaB__AFJ80660
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaaugaccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181542 - RNA, 1401 nt, Artificial Sequence; identical to SEQ ID NO: 181539
  derived and/or modified sequence opt4 from neuraminidase__InfluenzaB__AFJ80671

SEQ ID NO: 181543 - RNA, 1401 nt, Artificial Sequence; identical to SEQ ID NO: 181539
  derived and/or modified sequence opt4 from neuraminidase__InfluenzaB__AFJ80682

SEQ ID NO: 181544 - RNA, 1401 nt, Artificial Sequence
  derived and/or modified sequence opt4 from neuraminidase__InfluenzaB__AFJ80693
augcugcccagcaccauccagacccugacccuguuccugaccagcggcggcgugcugcugagccuguacgugagcgccagccugagcuaccugcuguacagcggcauccugcugaaguucagccccaccgagaucaccgcccccaccaugccccugaacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagccacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcggcgcccugacccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 181545 - RNA, 1401 nt, Artificial Sequence
  derived and/or modified sequence opt4 from neuraminidase__InfluenzaB__AFJ80726
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacagaggcggcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugcccauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181546 - RNA, 1401 nt, Artificial Sequence
  derived and/or modified sequence opt4 from neuraminidase__InfluenzaB__AFJ80737
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucagaggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181547 - RNA, 1401 nt, Artificial Sequence; identical to SEQ ID NO: 181188
  derived and/or modified sequence opt4 from neuraminidase__InfluenzaB__AFJ80759

SEQ ID NO: 181548 - RNA, 1401 nt, Artificial Sequence
  derived and/or modified sequence opt4 from neuraminidase__InfluenzaB__AFJ80770
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcuggacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaacccugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181549 - RNA, 1401 nt, Artificial Sequence; identical to SEQ ID NO: 181188
  derived and/or modified sequence opt4 from neuraminidase__InfluenzaB__AFJ80785

SEQ ID NO: 181550 - RNA, 1401 nt, Artificial Sequence; identical to SEQ ID NO: 181188
  derived and/or modified sequence opt4 from neuraminidase__InfluenzaB__AFJ80796

SEQ ID NO: 181551 - RNA, 1401 nt, Artificial Sequence
  derived and/or modified sequence opt4 from neuraminidase__InfluenzaB__AFJ80807
augcugcccagcaccauccagacccugacccuguuccugaccagcggcggcgugcugcugagccuguacgugagcgugagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181552 - RNA, 1401 nt, Artificial Sequence; identical to SEQ ID NO: 181188
  derived and/or modified sequence opt4 from neuraminidase__InfluenzaB__AFJ80818

SEQ ID NO: 181553 - RNA, 1401 nt, Artificial Sequence; identical to SEQ ID NO: 181188
  derived and/or modified sequence opt4 from neuraminidase__InfluenzaB__AFJ80829

SEQ ID NO: 181554 - RNA, 1401 nt, Artificial Sequence; identical to SEQ ID NO: 181525
  derived and/or modified sequence opt4 from neuraminidase__InfluenzaB__AFJ80840

SEQ ID NO: 181555 - RNA, 1401 nt, Artificial Sequence; identical to SEQ ID NO: 181525
  derived and/or modified sequence opt4 from neuraminidase__InfluenzaB__AFJ80851

SEQ ID NO: 181556 - RNA, 1401 nt, Artificial Sequence
  derived and/or modified sequence opt4 from neuraminidase__InfluenzaB__AFJ80862
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccaugaacagaagcgccaccaagggcgugacccugcugcugcccgagaccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181557 - RNA, 1401 nt, Artificial Sequence
  derived and/or modified sequence opt4 from neuraminidase__InfluenzaB__AFJ80873
augcugcccagcaccauccagacccugacccuguuccugaccagcggcggcgugcugcugagccuguacgugagcgccagccugagccaccugcuguacagcggcauccugcugaaguuccccagcaccgagaucaccgcccccaccaugccccuggacugcgccaacgccagcaacgugcaggccgugaacagaagcgccaccaagggcgugacccugcugccccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181558 - RNA, 1401 nt, Artificial Sequence
  derived and/or modified sequence opt4 from neuraminidase__InfluenzaB__AFJ80884
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcaagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181559 - RNA, 1401 nt, Artificial Sequence; identical to SEQ ID NO: 181524
  derived and/or modified sequence opt4 from neuraminidase__InfluenzaB__AFJ80895

SEQ ID NO: 181560 - RNA, 1401 nt, Artificial Sequence
  derived and/or modified sequence opt4 from neuraminidase__InfluenzaB__AFJ80917
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcaccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181561 - RNA, 1401 nt, Artificial Sequence
  derived and/or modified sequence opt4 from neuraminidase__InfluenzaB__AFJ80928
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcgagcccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181562 - RNA, 1401 nt, Artificial Sequence
  derived and/or modified sequence opt4 from neuraminidase__InfluenzaB__AFJ80939
augcugcccagcaccauccagacccugacccuguuccugaccagcggcggcgugcugcugagccuguacgugagcgccagccugagcuaccugcuguacagcgacauccugcugaaguucccccccaccgaggugaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181563 - RNA, 1401 nt, Artificial Sequence
  derived and/or modified sequence opt4 from neuraminidase__InfluenzaB__AFJ80950
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcaacggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181564 - RNA, 1401 nt, Artificial Sequence; identical to SEQ ID NO: 181525
  derived and/or modified sequence opt4 from neuraminidase__InfluenzaB__AFJ80961

SEQ ID NO: 181565 - RNA, 1401 nt, Artificial Sequence; identical to SEQ ID NO: 181308
  derived and/or modified sequence opt4 from neuraminidase__InfluenzaB__AFJ80972

SEQ ID NO: 181566 - RNA, 1401 nt, Artificial Sequence; identical to SEQ ID NO: 181308
  derived and/or modified sequence opt4 from neuraminidase__InfluenzaB__AFJ80983

SEQ ID NO: 181567 - RNA, 1401 nt, Artificial Sequence; identical to SEQ ID NO: 181263
  derived and/or modified sequence opt4 from neuraminidase__InfluenzaB__AFJ80994

SEQ ID NO: 181568 - RNA, 1401 nt, Artificial Sequence; identical to SEQ ID NO: 181308
  derived and/or modified sequence opt4 from neuraminidase__InfluenzaB__AFJ81005

SEQ ID NO: 181569 - RNA, 1401 nt, Artificial Sequence; identical to SEQ ID NO: 181308
  derived and/or modified sequence opt4 from neuraminidase__InfluenzaB__AFJ84364

SEQ ID NO: 181570 - RNA, 1401 nt, Artificial Sequence
  derived and/or modified sequence opt4 from neuraminidase__InfluenzaB__AFJ90399
augcugcccagcaccauccagacccugacccuguuccugaccagcggcggcgugcugcugagccuguacgugagcgccagccugagcuaccugcuguacagcgacauccugcugaaguuccccagcaccgagaucaccgccccccccaugccccuggacugcgccaacgccagcaacgugcaggccgugaacagaagcgccaccaagggcgugacccugcugcugcccgagcccgaguggaccuaccccagacugagcugccccggcagcaccuuccagagagcccugcugaucagcccccacagauucggcgagaccaagggcaacagcgccccccugaucaucagagagcccuucaucgccugcggccccagagagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaaugaccagcaagaucggcagaugguacagcagaaccaugagcaagaccgagagaaugggcaugggccuguacgugaaguacgacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181571 - RNA, 1401 nt, Artificial Sequence
  derived and/or modified sequence opt4 from neuraminidase__InfluenzaB__AFJ90410
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccaagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaaccugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181572 - RNA, 1401 nt, Artificial Sequence
  derived and/or modified sequence opt4 from neuraminidase__InfluenzaB__AFJ90432
augcugcccagcaccauccagacccugacccuguuccugaccagcggcggcgugcugcugagccuguacgugagcaccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181573 - RNA, 1401 nt, Artificial Sequence; identical to SEQ ID NO: 181492
  derived and/or modified sequence opt4 from neuraminidase__InfluenzaB__AFJ90443

SEQ ID NO: 181574 - RNA, 1401 nt, Artificial Sequence
  derived and/or modified sequence opt4 from neuraminidase__InfluenzaB__AFJ90454
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucgugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcgaguacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181575 - RNA, 1401 nt, Artificial Sequence
  derived and/or modified sequence opt4 from neuraminidase__InfluenzaB__AFJ91042
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugauccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucgccggccccugcgagagcgacggcgacaagggcagcggcggcaucaagggcggcuucgugcaccagagaaugaccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181576 - RNA, 1401 nt, Artificial Sequence
  derived and/or modified sequence opt4 from neuraminidase__InfluenzaB__AFJ91053
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaaggaggugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181577 - RNA, 1401 nt, Artificial Sequence
  derived and/or modified sequence opt4 from neuraminidase__InfluenzaB__AFJ91075
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacacccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181578 - RNA, 1401 nt, Artificial Sequence; identical to SEQ ID NO: 181337
  derived and/or modified sequence opt4 from neuraminidase__InfluenzaB__AFJ91086

SEQ ID NO: 181579 - RNA, 1401 nt, Artificial Sequence; identical to SEQ ID NO: 181337
  derived and/or modified sequence opt4 from neuraminidase__InfluenzaB__AFJ91097

SEQ ID NO: 181580 - RNA, 1401 nt, Artificial Sequence; identical to SEQ ID NO: 181337
  derived and/or modified sequence opt4 from neuraminidase__InfluenzaB__AFJ91108

SEQ ID NO: 181581 - RNA, 1401 nt, Artificial Sequence; identical to SEQ ID NO: 181337
  derived and/or modified sequence opt4 from neuraminidase__InfluenzaB__AFJ91119

SEQ ID NO: 181582 - RNA, 1401 nt, Artificial Sequence; identical to SEQ ID NO: 181188
  derived and/or modified sequence opt4 from neuraminidase__InfluenzaB__AFJ91707

SEQ ID NO: 181583 - RNA, 1401 nt, Artificial Sequence
  derived and/or modified sequence opt4 from neuraminidase__InfluenzaB__AFK09801
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacagaggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugcccauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181584 - RNA, 1401 nt, Artificial Sequence; identical to SEQ ID NO: 181312
  derived and/or modified sequence opt4 from neuraminidase__InfluenzaB__AFN54669

SEQ ID NO: 181585 - RNA, 1401 nt, Artificial Sequence; identical to SEQ ID NO: 181312
  derived and/or modified sequence opt4 from neuraminidase__InfluenzaB__AFN54680

SEQ ID NO: 181586 - RNA, 1401 nt, Artificial Sequence; identical to SEQ ID NO: 181337
  derived and/or modified sequence opt4 from neuraminidase__InfluenzaB__AFN54691

SEQ ID NO: 181587 - RNA, 1401 nt, Artificial Sequence; identical to SEQ ID NO: 181337
  derived and/or modified sequence opt4 from neuraminidase__InfluenzaB__AFN54702

SEQ ID NO: 181588 - RNA, 1401 nt, Artificial Sequence; identical to SEQ ID NO: 181337
  derived and/or modified sequence opt4 from neuraminidase__InfluenzaB__AFN54713

SEQ ID NO: 181589 - RNA, 1401 nt, Artificial Sequence; identical to SEQ ID NO: 181337
  derived and/or modified sequence opt4 from neuraminidase__InfluenzaB__AFN54724

SEQ ID NO: 181590 - RNA, 1401 nt, Artificial Sequence; identical to SEQ ID NO: 181337
  derived and/or modified sequence opt4 from neuraminidase__InfluenzaB__AFN54735

SEQ ID NO: 181591 - RNA, 1401 nt, Artificial Sequence; identical to SEQ ID NO: 181337
  derived and/or modified sequence opt4 from neuraminidase__InfluenzaB__AFN54746

SEQ ID NO: 181592 - RNA, 1401 nt, Artificial Sequence; identical to SEQ ID NO: 181337
  derived and/or modified sequence opt4 from neuraminidase__InfluenzaB__AFN54757

SEQ ID NO: 181593 - RNA, 1401 nt, Artificial Sequence; identical to SEQ ID NO: 181337
  derived and/or modified sequence opt4 from neuraminidase__InfluenzaB__AFN54768

SEQ ID NO: 181594 - RNA, 1401 nt, Artificial Sequence; identical to SEQ ID NO: 181337
  derived and/or modified sequence opt4 from neuraminidase__InfluenzaB__AFN54779

SEQ ID NO: 181595 - RNA, 1401 nt, Artificial Sequence; identical to SEQ ID NO: 181337
  derived and/or modified sequence opt4 from neuraminidase__InfluenzaB__AFN54790

SEQ ID NO: 181596 - RNA, 1401 nt, Artificial Sequence; identical to SEQ ID NO: 181337
  derived and/or modified sequence opt4 from neuraminidase__InfluenzaB__AFN54801

SEQ ID NO: 181597 - RNA, 1401 nt, Artificial Sequence; identical to SEQ ID NO: 181337
  derived and/or modified sequence opt4 from neuraminidase__InfluenzaB__AFN54812

SEQ ID NO: 181598 - RNA, 1401 nt, Artificial Sequence
  derived and/or modified sequence opt4 from neuraminidase__InfluenzaB__AFN54834
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaucuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181599 - RNA, 1401 nt, Artificial Sequence; identical to SEQ ID NO: 181337
  derived and/or modified sequence opt4 from neuraminidase__InfluenzaB__AFN54845

SEQ ID NO: 181600 - RNA, 1401 nt, Artificial Sequence
  derived and/or modified sequence opt4 from neuraminidase__InfluenzaB__AFN54856
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgccaccggcgugaacaugacccuguga

SEQ ID NO: 181601 - RNA, 1401 nt, Artificial Sequence; identical to SEQ ID NO: 181337
  derived and/or modified sequence opt4 from neuraminidase__InfluenzaB__AFN54867

SEQ ID NO: 181602 - RNA, 1401 nt, Artificial Sequence
  derived and/or modified sequence opt4 from neuraminidase__InfluenzaB__AFU34598
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaaccagagagagcgccugcaacugcaucggcggcaacugcuaccugaugaucaccgacggcagcgccagcggcgugagcgagugcagauuccugaagaucagagugggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacguggcccuguga

SEQ ID NO: 181603 - RNA, 1401 nt, Artificial Sequence
  derived and/or modified sequence opt4 from neuraminidase__InfluenzaB__AFU34609
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccagaggcgugaccuuccugcugcccgagcccgagugggccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181604 - RNA, 1401 nt, Artificial Sequence
  derived and/or modified sequence opt4 from neuraminidase__InfluenzaB__AFU34620
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccagaggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181605 - RNA, 1401 nt, Artificial Sequence
  derived and/or modified sequence opt4 from neuraminidase__InfluenzaB__AFU34631
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccagaggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucagaggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181606 - RNA, 1401 nt, Artificial Sequence
  derived and/or modified sequence opt4 from neuraminidase__InfluenzaB__AFU34642
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugagccuggacugcgccaacgccagcaacgugcaggccgugaacagaagcgccaccaagggcaugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacggcugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcuacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181607 - RNA, 1401 nt, Artificial Sequence
  derived and/or modified sequence opt4 from neuraminidase__InfluenzaB__AGB97261
augcugcccagcaccauccagacccugacccuguuccugaccagcggcggcgugcugcugagccuguacgugagcgccagccugagcuaccugcuguacagcgacaugcugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 181608 - RNA, 1401 nt, Artificial Sequence
  derived and/or modified sequence opt4 from neuraminidase__InfluenzaB__AGB97267
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcaccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcaucgacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181609 - RNA, 1401 nt, Artificial Sequence; identical to SEQ ID NO: 181337
  derived and/or modified sequence opt4 from neuraminidase__InfluenzaB__AGR54784

SEQ ID NO: 181610 - RNA, 1401 nt, Artificial Sequence; identical to SEQ ID NO: 181202
  derived and/or modified sequence opt4 from neuraminidase__InfluenzaB__AGX15491

SEQ ID NO: 181611 - RNA, 1401 nt, Artificial Sequence
  derived and/or modified sequence opt4 from neuraminidase__InfluenzaB__AGX15533
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaagagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaaggugggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181612 - RNA, 1401 nt, Artificial Sequence; identical to SEQ ID NO: 181155
  derived and/or modified sequence opt4 from neuraminidase__InfluenzaB__AGX15545

SEQ ID NO: 181613 - RNA, 1401 nt, Artificial Sequence; identical to SEQ ID NO: 181155
  derived and/or modified sequence opt4 from neuraminidase__InfluenzaB__AGX15556

SEQ ID NO: 181614 - RNA, 1401 nt, Artificial Sequence
  derived and/or modified sequence opt4 from neuraminidase__InfluenzaB__AGX15567
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181615 - RNA, 1401 nt, Artificial Sequence; identical to SEQ ID NO: 181155
  derived and/or modified sequence opt4 from neuraminidase__InfluenzaB__AGX15578

SEQ ID NO: 181616 - RNA, 1401 nt, Artificial Sequence; identical to SEQ ID NO: 181155
  derived and/or modified sequence opt4 from neuraminidase__InfluenzaB__AGX15589

SEQ ID NO: 181617 - RNA, 1401 nt, Artificial Sequence; identical to SEQ ID NO: 181361
  derived and/or modified sequence opt4 from neuraminidase__InfluenzaB__AGX15600

SEQ ID NO: 181618 - RNA, 1401 nt, Artificial Sequence; identical to SEQ ID NO: 181361
  derived and/or modified sequence opt4 from neuraminidase__InfluenzaB__AGX15611

SEQ ID NO: 181619 - RNA, 1401 nt, Artificial Sequence; identical to SEQ ID NO: 181481
  derived and/or modified sequence opt4 from neuraminidase__InfluenzaB__AGX15644

SEQ ID NO: 181620 - RNA, 1401 nt, Artificial Sequence; identical to SEQ ID NO: 181481
  derived and/or modified sequence opt4 from neuraminidase__InfluenzaB__AGX15655

SEQ ID NO: 181621 - RNA, 1401 nt, Artificial Sequence; identical to SEQ ID NO: 181481
  derived and/or modified sequence opt4 from neuraminidase__InfluenzaB__AGX15666

SEQ ID NO: 181622 - RNA, 1401 nt, Artificial Sequence; identical to SEQ ID NO: 181481
  derived and/or modified sequence opt4 from neuraminidase__InfluenzaB__AGX15679

SEQ ID NO: 181623 - RNA, 1401 nt, Artificial Sequence
  derived and/or modified sequence opt4 from neuraminidase__InfluenzaB__AGX15690
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181624 - RNA, 1401 nt, Artificial Sequence; identical to SEQ ID NO: 181481
  derived and/or modified sequence opt4 from neuraminidase__InfluenzaB__AGX15701

SEQ ID NO: 181625 - RNA, 1401 nt, Artificial Sequence
  derived and/or modified sequence opt4 from neuraminidase__InfluenzaB__AGX15712
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagcccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181626 - RNA, 1401 nt, Artificial Sequence; identical to SEQ ID NO: 181481
  derived and/or modified sequence opt4 from neuraminidase__InfluenzaB__AGX15723

SEQ ID NO: 181627 - RNA, 1401 nt, Artificial Sequence; identical to SEQ ID NO: 181481
  derived and/or modified sequence opt4 from neuraminidase__InfluenzaB__AGX15745

SEQ ID NO: 181628 - RNA, 1401 nt, Artificial Sequence; identical to SEQ ID NO: 181481
  derived and/or modified sequence opt4 from neuraminidase__InfluenzaB__AGX15757

SEQ ID NO: 181629 - RNA, 1401 nt, Artificial Sequence
  derived and/or modified sequence opt4 from neuraminidase__InfluenzaB__AGX15768
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugaugaucagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181630 - RNA, 1401 nt, Artificial Sequence
  derived and/or modified sequence opt4 from neuraminidase__InfluenzaB__AGX15801
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugagccuggacugcgugaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181631 - RNA, 1401 nt, Artificial Sequence; identical to SEQ ID NO: 181481
  derived and/or modified sequence opt4 from neuraminidase__InfluenzaB__AGX15812

SEQ ID NO: 181632 - RNA, 1401 nt, Artificial Sequence; identical to SEQ ID NO: 181481
  derived and/or modified sequence opt4 from neuraminidase__InfluenzaB__AGX15823

SEQ ID NO: 181633 - RNA, 1401 nt, Artificial Sequence; identical to SEQ ID NO: 181415
  derived and/or modified sequence opt4 from neuraminidase__InfluenzaB__AGX15845

SEQ ID NO: 181634 - RNA, 1401 nt, Artificial Sequence; identical to SEQ ID NO: 181392
  derived and/or modified sequence opt4 from neuraminidase__InfluenzaB__AGX15856

SEQ ID NO: 181635 - RNA, 1401 nt, Artificial Sequence; identical to SEQ ID NO: 181415
  derived and/or modified sequence opt4 from neuraminidase__InfluenzaB__AGX15867

SEQ ID NO: 181636 - RNA, 1401 nt, Artificial Sequence; identical to SEQ ID NO: 181415
  derived and/or modified sequence opt4 from neuraminidase__InfluenzaB__AGX15889

SEQ ID NO: 181637 - RNA, 1401 nt, Artificial Sequence
  derived and/or modified sequence opt4 from neuraminidase__InfluenzaB__AGX15900
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacaccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaagaggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181638 - RNA, 1401 nt, Artificial Sequence; identical to SEQ ID NO: 181415
  derived and/or modified sequence opt4 from neuraminidase__InfluenzaB__AGX15911

SEQ ID NO: 181639 - RNA, 1401 nt, Artificial Sequence
  derived and/or modified sequence opt4 from neuraminidase__InfluenzaB__AGX15933
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181640 - RNA, 1401 nt, Artificial Sequence; identical to SEQ ID NO: 181415
  derived and/or modified sequence opt4 from neuraminidase__InfluenzaB__AGX15944

SEQ ID NO: 181641 - RNA, 1401 nt, Artificial Sequence; identical to SEQ ID NO: 181476
  derived and/or modified sequence opt4 from neuraminidase__InfluenzaB__AGX15966

SEQ ID NO: 181642 - RNA, 1401 nt, Artificial Sequence
  derived and/or modified sequence opt4 from neuraminidase__InfluenzaB__AGX15988
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgaggugagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181643 - RNA, 1401 nt, Artificial Sequence; identical to SEQ ID NO: 181476
  derived and/or modified sequence opt4 from neuraminidase__InfluenzaB__AGX15999

SEQ ID NO: 181644 - RNA, 1401 nt, Artificial Sequence; identical to SEQ ID NO: 181476
  derived and/or modified sequence opt4 from neuraminidase__InfluenzaB__AGX16010

SEQ ID NO: 181645 - RNA, 1401 nt, Artificial Sequence; identical to SEQ ID NO: 181476
  derived and/or modified sequence opt4 from neuraminidase__InfluenzaB__AGX16021

SEQ ID NO: 181646 - RNA, 1401 nt, Artificial Sequence
  derived and/or modified sequence opt4 from neuraminidase__InfluenzaB__AGX16032
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181647 - RNA, 1401 nt, Artificial Sequence; identical to SEQ ID NO: 181263
  derived and/or modified sequence opt4 from neuraminidase__InfluenzaB__AGX16043

SEQ ID NO: 181648 - RNA, 1401 nt, Artificial Sequence; identical to SEQ ID NO: 181265
  derived and/or modified sequence opt4 from neuraminidase__InfluenzaB__AGX16054

SEQ ID NO: 181649 - RNA, 1401 nt, Artificial Sequence
  derived and/or modified sequence opt4 from neuraminidase__InfluenzaB__AGX16087
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacaacuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181650 - RNA, 1401 nt, Artificial Sequence
  derived and/or modified sequence opt4 from neuraminidase__InfluenzaB__AGX16109
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcuggacguggagaccgacaccgccgagaucagacugaugugcaccgagaccuaccuggacacccccagacccaacgacggcagcaucaccggccccugcgaggccaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181651 - RNA, 1401 nt, Artificial Sequence
  derived and/or modified sequence opt4 from neuraminidase__InfluenzaB__AGX16120
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181652 - RNA, 1401 nt, Artificial Sequence; identical to SEQ ID NO: 181651
  derived and/or modified sequence opt4 from neuraminidase__InfluenzaB__AGX16131

SEQ ID NO: 181653 - RNA, 1401 nt, Artificial Sequence; identical to SEQ ID NO: 181651
  derived and/or modified sequence opt4 from neuraminidase__InfluenzaB__AGX16142

SEQ ID NO: 181654 - RNA, 1401 nt, Artificial Sequence
  derived and/or modified sequence opt4 from neuraminidase__InfluenzaB__AGX16153
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccagaggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacaugaccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181655 - RNA, 1401 nt, Artificial Sequence; identical to SEQ ID NO: 181649
  derived and/or modified sequence opt4 from neuraminidase__InfluenzaB__AGX16164

SEQ ID NO: 181656 - RNA, 1401 nt, Artificial Sequence; identical to SEQ ID NO: 181308
  derived and/or modified sequence opt4 from neuraminidase__InfluenzaB__AGX16197

SEQ ID NO: 181657 - RNA, 1401 nt, Artificial Sequence; identical to SEQ ID NO: 181308
  derived and/or modified sequence opt4 from neuraminidase__InfluenzaB__AGX16208

SEQ ID NO: 181658 - RNA, 1401 nt, Artificial Sequence; identical to SEQ ID NO: 181308
  derived and/or modified sequence opt4 from neuraminidase__InfluenzaB__AGX16219

SEQ ID NO: 181659 - RNA, 1401 nt, Artificial Sequence; identical to SEQ ID NO: 181147
  derived and/or modified sequence opt4 from neuraminidase__InfluenzaB__AGX16230

SEQ ID NO: 181660 - RNA, 1401 nt, Artificial Sequence
  derived and/or modified sequence opt4 from neuraminidase__InfluenzaB__AGX16241
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaucggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccugacccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181661 - RNA, 1401 nt, Artificial Sequence
  derived and/or modified sequence opt4 from neuraminidase__InfluenzaB__AGX16252
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgagugggccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181662 - RNA, 1401 nt, Artificial Sequence; identical to SEQ ID NO: 181308
  derived and/or modified sequence opt4 from neuraminidase__InfluenzaB__AGX16274

SEQ ID NO: 181663 - RNA, 1401 nt, Artificial Sequence
  derived and/or modified sequence opt4 from neuraminidase__InfluenzaB__AGX16285
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaccaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181664 - RNA, 1401 nt, Artificial Sequence; identical to SEQ ID NO: 181308
  derived and/or modified sequence opt4 from neuraminidase__InfluenzaB__AGX16296

SEQ ID NO: 181665 - RNA, 1401 nt, Artificial Sequence; identical to SEQ ID NO: 181155
  derived and/or modified sequence opt4 from neuraminidase__InfluenzaB__AGX16307

SEQ ID NO: 181666 - RNA, 1401 nt, Artificial Sequence; identical to SEQ ID NO: 181308
  derived and/or modified sequence opt4 from neuraminidase__InfluenzaB__AGX16329

SEQ ID NO: 181667 - RNA, 1401 nt, Artificial Sequence
  derived and/or modified sequence opt4 from neuraminidase__InfluenzaB__AGX16362
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181668 - RNA, 1401 nt, Artificial Sequence; identical to SEQ ID NO: 181480
  derived and/or modified sequence opt4 from neuraminidase__InfluenzaB__AGX16373

SEQ ID NO: 181669 - RNA, 1401 nt, Artificial Sequence
  derived and/or modified sequence opt4 from neuraminidase__InfluenzaB__AGX16384
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugaagcaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181670 - RNA, 1401 nt, Artificial Sequence; identical to SEQ ID NO: 181337
  derived and/or modified sequence opt4 from neuraminidase__InfluenzaB__AGX16406

SEQ ID NO: 181671 - RNA, 1401 nt, Artificial Sequence; identical to SEQ ID NO: 181337
  derived and/or modified sequence opt4 from neuraminidase__InfluenzaB__AGX16427

SEQ ID NO: 181672 - RNA, 1401 nt, Artificial Sequence; identical to SEQ ID NO: 181337
  derived and/or modified sequence opt4 from neuraminidase__InfluenzaB__AGX16438

SEQ ID NO: 181673 - RNA, 1401 nt, Artificial Sequence; identical to SEQ ID NO: 181337
  derived and/or modified sequence opt4 from neuraminidase__InfluenzaB__AGX16449

SEQ ID NO: 181674 - RNA, 1401 nt, Artificial Sequence; identical to SEQ ID NO: 181337
  derived and/or modified sequence opt4 from neuraminidase__InfluenzaB__AGX16460

SEQ ID NO: 181675 - RNA, 1401 nt, Artificial Sequence
  derived and/or modified sequence opt4 from neuraminidase__InfluenzaB__AGX16471
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181676 - RNA, 1401 nt, Artificial Sequence; identical to SEQ ID NO: 181337
  derived and/or modified sequence opt4 from neuraminidase__InfluenzaB__AGX16482

SEQ ID NO: 181677 - RNA, 1401 nt, Artificial Sequence
  derived and/or modified sequence opt4 from neuraminidase__InfluenzaB__AGX16493
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugguggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181678 - RNA, 1401 nt, Artificial Sequence; identical to SEQ ID NO: 181136
  derived and/or modified sequence opt4 from neuraminidase__InfluenzaB__AGX16504

SEQ ID NO: 181679 - RNA, 1401 nt, Artificial Sequence; identical to SEQ ID NO: 181136
  derived and/or modified sequence opt4 from neuraminidase__InfluenzaB__AGX16515

SEQ ID NO: 181680 - RNA, 1401 nt, Artificial Sequence
  derived and/or modified sequence opt4 from neuraminidase__InfluenzaB__AGX16548
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaacggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181681 - RNA, 1401 nt, Artificial Sequence
  derived and/or modified sequence opt4 from neuraminidase__InfluenzaB__AGX16559
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181682 - RNA, 1401 nt, Artificial Sequence
  derived and/or modified sequence opt4 from neuraminidase__InfluenzaB__AGX16581
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181683 - RNA, 1401 nt, Artificial Sequence; identical to SEQ ID NO: 181682
  derived and/or modified sequence opt4 from neuraminidase__InfluenzaB__AGX16592

SEQ ID NO: 181684 - RNA, 1401 nt, Artificial Sequence; identical to SEQ ID NO: 181136
  derived and/or modified sequence opt4 from neuraminidase__InfluenzaB__AGX16603

SEQ ID NO: 181685 - RNA, 1401 nt, Artificial Sequence; identical to SEQ ID NO: 181202
  derived and/or modified sequence opt4 from neuraminidase__InfluenzaB__AGX16614

SEQ ID NO: 181686 - RNA, 1401 nt, Artificial Sequence; identical to SEQ ID NO: 181680
  derived and/or modified sequence opt4 from neuraminidase__InfluenzaB__AGX16625

SEQ ID NO: 181687 - RNA, 1401 nt, Artificial Sequence
  derived and/or modified sequence opt4 from neuraminidase__InfluenzaB__AGX16636
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcuguggaacaccgugaccggcguggacauggcccuguga

SEQ ID NO: 181688 - RNA, 1401 nt, Artificial Sequence; identical to SEQ ID NO: 181134
  derived and/or modified sequence opt4 from neuraminidase__InfluenzaB__AGX16647

SEQ ID NO: 181689 - RNA, 1401 nt, Artificial Sequence; identical to SEQ ID NO: 181682
  derived and/or modified sequence opt4 from neuraminidase__InfluenzaB__AGX16658

SEQ ID NO: 181690 - RNA, 1401 nt, Artificial Sequence; identical to SEQ ID NO: 181136
  derived and/or modified sequence opt4 from neuraminidase__InfluenzaB__AGX16669

SEQ ID NO: 181691 - RNA, 1401 nt, Artificial Sequence; identical to SEQ ID NO: 181202
  derived and/or modified sequence opt4 from neuraminidase__InfluenzaB__AGX16680

SEQ ID NO: 181692 - RNA, 1401 nt, Artificial Sequence; identical to SEQ ID NO: 181136
  derived and/or modified sequence opt4 from neuraminidase__InfluenzaB__AGX16691

SEQ ID NO: 181693 - RNA, 1401 nt, Artificial Sequence
  derived and/or modified sequence opt4 from neuraminidase__InfluenzaB__AGX16702
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaagagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181694 - RNA, 1401 nt, Artificial Sequence
  derived and/or modified sequence opt4 from neuraminidase__InfluenzaB__AGX16713
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaucuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181695 - RNA, 1401 nt, Artificial Sequence; identical to SEQ ID NO: 181136
  derived and/or modified sequence opt4 from neuraminidase__InfluenzaB__AGX16724

SEQ ID NO: 181696 - RNA, 1401 nt, Artificial Sequence; identical to SEQ ID NO: 181682
  derived and/or modified sequence opt4 from neuraminidase__InfluenzaB__AGX16735

SEQ ID NO: 181697 - RNA, 1401 nt, Artificial Sequence; identical to SEQ ID NO: 181682
  derived and/or modified sequence opt4 from neuraminidase__InfluenzaB__AGX16746

SEQ ID NO: 181698 - RNA, 1401 nt, Artificial Sequence; identical to SEQ ID NO: 181136
  derived and/or modified sequence opt4 from neuraminidase__InfluenzaB__AGX16757

SEQ ID NO: 181699 - RNA, 1401 nt, Artificial Sequence
  derived and/or modified sequence opt4 from neuraminidase__InfluenzaB__AGX16768
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcaagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181700 - RNA, 1401 nt, Artificial Sequence; identical to SEQ ID NO: 181202
  derived and/or modified sequence opt4 from neuraminidase__InfluenzaB__AGX16779

SEQ ID NO: 181701 - RNA, 1401 nt, Artificial Sequence
  derived and/or modified sequence opt4 from neuraminidase__InfluenzaB__AGX16790
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcggcagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181702 - RNA, 1401 nt, Artificial Sequence
  derived and/or modified sequence opt4 from neuraminidase__InfluenzaB__AGX16801
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181703 - RNA, 1401 nt, Artificial Sequence; identical to SEQ ID NO: 181136
  derived and/or modified sequence opt4 from neuraminidase__InfluenzaB__AGX16812

SEQ ID NO: 181704 - RNA, 1401 nt, Artificial Sequence
  derived and/or modified sequence opt4 from neuraminidase__InfluenzaB__AGX16823
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgccgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181705 - RNA, 1401 nt, Artificial Sequence; identical to SEQ ID NO: 181136
  derived and/or modified sequence opt4 from neuraminidase__InfluenzaB__AGX16834

SEQ ID NO: 181706 - RNA, 1401 nt, Artificial Sequence
  derived and/or modified sequence opt4 from neuraminidase__InfluenzaB__AGX16845
augcugcccagcaccauccagacccugacccuguuccugaccagcggcggcgugcugcugagccuguacgugagcgccagccugagcuaccugcuguacagcgacauccugcugaaguucagccccaccgagaucaccacccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcuggugagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181707 - RNA, 1401 nt, Artificial Sequence
  derived and/or modified sequence opt4 from neuraminidase__InfluenzaB__AGX16856
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccgugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacagcggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaacaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181708 - RNA, 1401 nt, Artificial Sequence; identical to SEQ ID NO: 181136
  derived and/or modified sequence opt4 from neuraminidase__InfluenzaB__AGX16867

SEQ ID NO: 181709 - RNA, 1401 nt, Artificial Sequence
  derived and/or modified sequence opt4 from neuraminidase__InfluenzaB__AGX16878
augcugcccagcaccauccagacccugacccuguuccugaccagcggcggcgugcugcugagccuguacgugagcgccagccugagcuaccugcuguacagcgacauccugcugaaguucagccccaccgagcugaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaagagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaacggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181710 - RNA, 1401 nt, Artificial Sequence; identical to SEQ ID NO: 181682
  derived and/or modified sequence opt4 from neuraminidase__InfluenzaB__AGX16889

SEQ ID NO: 181711 - RNA, 1401 nt, Artificial Sequence
  derived and/or modified sequence opt4 from neuraminidase__InfluenzaB__AGX16900
augcugcccagcaccauccagacccugacccuguuccugaccaccggcggcgugcugcugagccuguacgugagcgccagccugagcuaccugcuguacagcgacauccugcugaaguucagccccaccgagaucaucgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181712 - RNA, 1401 nt, Artificial Sequence
  derived and/or modified sequence opt4 from neuraminidase__InfluenzaB__AGX16911
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181713 - RNA, 1401 nt, Artificial Sequence
  derived and/or modified sequence opt4 from neuraminidase__InfluenzaB__AGX16922
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181714 - RNA, 1401 nt, Artificial Sequence
  derived and/or modified sequence opt4 from neuraminidase__InfluenzaB__AGX16933
augcugcccagcaccauccagacccugacccuguuccugaccagcggcggcgugcugcugagccuguacgugagcgccagccugagcuaccugcuguacagcgacauccugcugaaguucagccccaccgagaucaacgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugcuggacaccgugaccggcguggacauggcccuguga

SEQ ID NO: 181715 - RNA, 1401 nt, Artificial Sequence
  derived and/or modified sequence opt4 from neuraminidase__InfluenzaB__AGX16944
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacagcggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaacaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181716 - RNA, 1401 nt, Artificial Sequence; identical to SEQ ID NO: 181136
  derived and/or modified sequence opt4 from neuraminidase__InfluenzaB__AGX16955

SEQ ID NO: 181717 - RNA, 1401 nt, Artificial Sequence; identical to SEQ ID NO: 181134
  derived and/or modified sequence opt4 from neuraminidase__InfluenzaB__AGX16966

SEQ ID NO: 181718 - RNA, 1401 nt, Artificial Sequence; identical to SEQ ID NO: 181136
  derived and/or modified sequence opt4 from neuraminidase__InfluenzaB__AGX16977

SEQ ID NO: 181719 - RNA, 1401 nt, Artificial Sequence; identical to SEQ ID NO: 181136
  derived and/or modified sequence opt4 from neuraminidase__InfluenzaB__AGX16988

SEQ ID NO: 181720 - RNA, 1401 nt, Artificial Sequence; identical to SEQ ID NO: 181680
  derived and/or modified sequence opt4 from neuraminidase__InfluenzaB__AGX16999

SEQ ID NO: 181721 - RNA, 1401 nt, Artificial Sequence; identical to SEQ ID NO: 181136
  derived and/or modified sequence opt4 from neuraminidase__InfluenzaB__AGX17010

SEQ ID NO: 181722 - RNA, 1401 nt, Artificial Sequence; identical to SEQ ID NO: 181682
  derived and/or modified sequence opt4 from neuraminidase__InfluenzaB__AGX17021

SEQ ID NO: 181723 - RNA, 1401 nt, Artificial Sequence
  derived and/or modified sequence opt4 from neuraminidase__InfluenzaB__AGX17032
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcgacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacagaaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181724 - RNA, 1401 nt, Artificial Sequence; identical to SEQ ID NO: 181134
  derived and/or modified sequence opt4 from neuraminidase__InfluenzaB__AGX17043

SEQ ID NO: 181725 - RNA, 1401 nt, Artificial Sequence
  derived and/or modified sequence opt4 from neuraminidase__InfluenzaB__AGX17054
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaacggcaacggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181726 - RNA, 1401 nt, Artificial Sequence
  derived and/or modified sequence opt4 from neuraminidase__InfluenzaB__AGX17065
augcugcccagcaccauccagacccugacccuguuccugaccagcggcggcgugcugcugagccuguacgugagcgcccugcugagcuaccugcuguacagcgacauccugcugaaguucagccccaccaagaucaucgcccccaccaccagccuggacagcgccaacgccagcaacuuccaggccgugaaccacagcgccaccaaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaucagcaagaccaagagaaugggcauggagcuguacgugaaguacgacggcgaccccuggaccgacagcgacgcccuggcccccagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181727 - RNA, 1401 nt, Artificial Sequence
  derived and/or modified sequence opt4 from neuraminidase__InfluenzaB__AGX17076
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagaucgugcacgacggcggcaaggagaccuggcacagcgccgccaccgccaucuacugccugaugggcagcggccagcugcugugggacaccgugaccggcguggacauggcccuguga

SEQ ID NO: 181728 - RNA, 1401 nt, Artificial Sequence; identical to SEQ ID NO: 181682
  derived and/or modified sequence opt4 from neuraminidase__InfluenzaB__AGX17087

SEQ ID NO: 181729 - RNA, 1401 nt, Artificial Sequence; identical to SEQ ID NO: 181682
  derived and/or modified sequence opt4 from neuraminidase__InfluenzaB__AGX17098

SEQ ID NO: 181730 - RNA, 1401 nt, Artificial Sequence; identical to SEQ ID NO: 181682
  derived and/or modified sequence opt4 from neuraminidase__InfluenzaB__AGX17109

SEQ ID NO: 181731 - RNA, 1401 nt, Artificial Sequence; identical to SEQ ID NO: 181682
  derived and/or modified sequence opt4 from neuraminidase__InfluenzaB__AGX17120

SEQ ID NO: 181732 - RNA, 1401 nt, Artificial Sequence; identical to SEQ ID NO: 181134
  derived and/or modified sequence opt4 from neuraminidase__InfluenzaB__AGX17131

SEQ ID NO: 181733 - RNA, 1401 nt, Artificial Sequence; identical to SEQ ID NO: 181136
  derived and/or modified sequence opt4 from neuraminidase__InfluenzaB__AGX17142

SEQ ID NO: 181734 - RNA, 1401 nt, Artificial Sequence
  derived and/or modified sequence opt4 from neuraminidase__InfluenzaB__AGX17153
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaucggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181735 - RNA, 1401 nt, Artificial Sequence; identical to SEQ ID NO: 181682
  derived and/or modified sequence opt4 from neuraminidase__InfluenzaB__AGX17164

SEQ ID NO: 181736 - RNA, 1404 nt, Artificial Sequence
  derived and/or modified sequence opt4 from neuraminidase__InfluenzaB__AGX17175
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181737 - RNA, 1401 nt, Artificial Sequence
  derived and/or modified sequence opt4 from neuraminidase__InfluenzaB__AGX17186
augcugcccagcaccauccagacccugacccuguuccugaccagcggcggcgugcugcugagccuguacgugagcgccagccugagcuaccugcuguacagcgacauccugcugaaguucagccccaccgagaucaccacccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaaguacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181738 - RNA, 1401 nt, Artificial Sequence; identical to SEQ ID NO: 181713
  derived and/or modified sequence opt4 from neuraminidase__InfluenzaB__AGX17197

SEQ ID NO: 181739 - RNA, 1401 nt, Artificial Sequence
  derived and/or modified sequence opt4 from neuraminidase__InfluenzaB__AGX17208
augcugcccagcaccauccagacccugacccuguuccugaccagcggcggcgugcugcugagccuguacgugagcgccagccugagcuaccugcuguacagcgacauccugcugaaguucagccccaccgagaucaccacccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181740 - RNA, 1401 nt, Artificial Sequence; identical to SEQ ID NO: 181682
  derived and/or modified sequence opt4 from neuraminidase__InfluenzaB__AGX17219

SEQ ID NO: 181741 - RNA, 1401 nt, Artificial Sequence; identical to SEQ ID NO: 181136
  derived and/or modified sequence opt4 from neuraminidase__InfluenzaB__AGX17230

SEQ ID NO: 181742 - RNA, 1401 nt, Artificial Sequence; identical to SEQ ID NO: 181682
  derived and/or modified sequence opt4 from neuraminidase__InfluenzaB__AGX17241

SEQ ID NO: 181743 - RNA, 1401 nt, Artificial Sequence
  derived and/or modified sequence opt4 from neuraminidase__InfluenzaB__AGX17252
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcuggaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugaccuacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgccgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181744 - RNA, 1401 nt, Artificial Sequence
  derived and/or modified sequence opt4 from neuraminidase__InfluenzaB__AGX17263
augcugcccagcaccauccagacccugacccuguuccugaccagcggcggcgugcugcugagccuguacgugagcgccagccugagcuaccugcuguacagcgacauccugcugaagcugagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181745 - RNA, 1401 nt, Artificial Sequence
  derived and/or modified sequence opt4 from neuraminidase__InfluenzaB__AGX17274
augcugcccagcaccauccagacccugacccuguuccugaccagcggcggcgugcugcugagccuguacgugagcgccagccugagcuaccugcuguacagcgacauccugcugaaguucagccccaccgagaucaacgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181746 - RNA, 1401 nt, Artificial Sequence
  derived and/or modified sequence opt4 from neuraminidase__InfluenzaB__AGX17285
augcugcccagcaccauccagacccugacccuguuccugaccagcggcggcgugcugcugagccuguacaugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181747 - RNA, 1401 nt, Artificial Sequence
  derived and/or modified sequence opt4 from neuraminidase__InfluenzaB__AGX17296
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181748 - RNA, 1401 nt, Artificial Sequence; identical to SEQ ID NO: 181680
  derived and/or modified sequence opt4 from neuraminidase__InfluenzaB__AGX17307

SEQ ID NO: 181749 - RNA, 1401 nt, Artificial Sequence; identical to SEQ ID NO: 181134
  derived and/or modified sequence opt4 from neuraminidase__InfluenzaB__AGX17318

SEQ ID NO: 181750 - RNA, 1401 nt, Artificial Sequence
  derived and/or modified sequence opt4 from neuraminidase__InfluenzaB__AGX17329
augcugcccagcaccauccagacccugacccuguuccugaccagcggcggcgugcugcugagccuguacgugagcgccagccugagcuaccugcuguacagcgacaugcugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacagcggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaacaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181751 - RNA, 1401 nt, Artificial Sequence; identical to SEQ ID NO: 181682
  derived and/or modified sequence opt4 from neuraminidase__InfluenzaB__AGX17340

SEQ ID NO: 181752 - RNA, 1401 nt, Artificial Sequence
  derived and/or modified sequence opt4 from neuraminidase__InfluenzaB__AGX17351
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagaccaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181753 - RNA, 1401 nt, Artificial Sequence
  derived and/or modified sequence opt4 from neuraminidase__InfluenzaB__AGX17362
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaucccccuggacugcgccaacgccagcaacauccaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181754 - RNA, 1401 nt, Artificial Sequence
  derived and/or modified sequence opt4 from neuraminidase__InfluenzaB__AGX17373
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccaacaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181755 - RNA, 1401 nt, Artificial Sequence; identical to SEQ ID NO: 181134
  derived and/or modified sequence opt4 from neuraminidase__InfluenzaB__AGX17384

SEQ ID NO: 181756 - RNA, 1401 nt, Artificial Sequence; identical to SEQ ID NO: 181202
  derived and/or modified sequence opt4 from neuraminidase__InfluenzaB__AGX17395

SEQ ID NO: 181757 - RNA, 1401 nt, Artificial Sequence
  derived and/or modified sequence opt4 from neuraminidase__InfluenzaB__AGX17404
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggcagcgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcaucauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181758 - RNA, 1401 nt, Artificial Sequence
  derived and/or modified sequence opt4 from neuraminidase__InfluenzaB__AGX17415
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgacuggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181759 - RNA, 1401 nt, Artificial Sequence
  derived and/or modified sequence opt4 from neuraminidase__InfluenzaB__AGX17426
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181760 - RNA, 1401 nt, Artificial Sequence
  derived and/or modified sequence opt4 from neuraminidase__InfluenzaB__AGX17437
augcugcccagcaccauccagacccugacccuguuccugaccagcggcggcgugcugcugagccuguacgugagcgugagccugagcuaccugcuguacagcgacauccugcugaaguucagccccaccgagaucaccgcccagaccaugccccuggacuucgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181761 - RNA, 1401 nt, Artificial Sequence
  derived and/or modified sequence opt4 from neuraminidase__InfluenzaB__AGX17448
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagaccaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggugcugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181762 - RNA, 1401 nt, Artificial Sequence
  derived and/or modified sequence opt4 from neuraminidase__InfluenzaB__AGX17459
augcugcccagcaccauccagacccugacccuguuccugaccagcggcggcgugcugcugagccuguacgugagcgccagccugagcuaccugcuguacagcgacauccugcugaaguucagccccaccgagaucaccgccagcaccaugccccuggacugcgccaacgccagcaacgugcaggccgugaacagaagcgccaccaagggcgugacccugcugcugcccgagcccgacuggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181763 - RNA, 1401 nt, Artificial Sequence; identical to SEQ ID NO: 181134
  derived and/or modified sequence opt4 from neuraminidase__InfluenzaB__AGX17470

SEQ ID NO: 181764 - RNA, 1401 nt, Artificial Sequence
  derived and/or modified sequence opt4 from neuraminidase__InfluenzaB__AGX17481
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugauccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcguggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181765 - RNA, 1401 nt, Artificial Sequence
  derived and/or modified sequence opt4 from neuraminidase__InfluenzaB__AGX17492
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacaucgcccuguga

SEQ ID NO: 181766 - RNA, 1401 nt, Artificial Sequence
  derived and/or modified sequence opt4 from neuraminidase__InfluenzaB__AGX17503
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggccugaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181767 - RNA, 1401 nt, Artificial Sequence; identical to SEQ ID NO: 181134
  derived and/or modified sequence opt4 from neuraminidase__InfluenzaB__AGX17514

SEQ ID NO: 181768 - RNA, 1401 nt, Artificial Sequence
  derived and/or modified sequence opt4 from neuraminidase__InfluenzaB__AGX17525
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaagagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181769 - RNA, 1401 nt, Artificial Sequence; identical to SEQ ID NO: 181713
  derived and/or modified sequence opt4 from neuraminidase__InfluenzaB__AGX17536

SEQ ID NO: 181770 - RNA, 1401 nt, Artificial Sequence; identical to SEQ ID NO: 181744
  derived and/or modified sequence opt4 from neuraminidase__InfluenzaB__AGX17547

SEQ ID NO: 181771 - RNA, 1401 nt, Artificial Sequence
  derived and/or modified sequence opt4 from neuraminidase__InfluenzaB__AGX17558
augcugcccagcaccauccagacccugacccuguuccugaccagcggcggcgugcugcugagccuguacgugagcgccagccugagcuaccugcuguacagcgacgugcugcugaaguucagccccgccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181772 - RNA, 1401 nt, Artificial Sequence; identical to SEQ ID NO: 181263
  derived and/or modified sequence opt4 from neuraminidase__InfluenzaB__AGX17569

SEQ ID NO: 181773 - RNA, 1401 nt, Artificial Sequence; identical to SEQ ID NO: 181190
  derived and/or modified sequence opt4 from neuraminidase__InfluenzaB__AGX17580

SEQ ID NO: 181774 - RNA, 1401 nt, Artificial Sequence
  derived and/or modified sequence opt4 from neuraminidase__InfluenzaB__AGX17591
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181775 - RNA, 1401 nt, Artificial Sequence; identical to SEQ ID NO: 181188
  derived and/or modified sequence opt4 from neuraminidase__InfluenzaB__AGX17602

SEQ ID NO: 181776 - RNA, 1401 nt, Artificial Sequence; identical to SEQ ID NO: 181774
  derived and/or modified sequence opt4 from neuraminidase__InfluenzaB__AGX17613

SEQ ID NO: 181777 - RNA, 1401 nt, Artificial Sequence; identical to SEQ ID NO: 181361
  derived and/or modified sequence opt4 from neuraminidase__InfluenzaB__AGX17624

SEQ ID NO: 181778 - RNA, 1401 nt, Artificial Sequence
  derived and/or modified sequence opt4 from neuraminidase__InfluenzaB__AGX17635
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181779 - RNA, 1401 nt, Artificial Sequence; identical to SEQ ID NO: 181361
  derived and/or modified sequence opt4 from neuraminidase__InfluenzaB__AGX17657

SEQ ID NO: 181780 - RNA, 1401 nt, Artificial Sequence; identical to SEQ ID NO: 181774
  derived and/or modified sequence opt4 from neuraminidase__InfluenzaB__AGX17668

SEQ ID NO: 181781 - RNA, 1401 nt, Artificial Sequence
  derived and/or modified sequence opt4 from neuraminidase__InfluenzaB__AGX17679
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181782 - RNA, 1401 nt, Artificial Sequence; identical to SEQ ID NO: 181361
  derived and/or modified sequence opt4 from neuraminidase__InfluenzaB__AGX17690

SEQ ID NO: 181783 - RNA, 1401 nt, Artificial Sequence
  derived and/or modified sequence opt4 from neuraminidase__InfluenzaB__AGX17701
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaagagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181784 - RNA, 1401 nt, Artificial Sequence; identical to SEQ ID NO: 181361
  derived and/or modified sequence opt4 from neuraminidase__InfluenzaB__AGX17723

SEQ ID NO: 181785 - RNA, 1401 nt, Artificial Sequence; identical to SEQ ID NO: 181781
  derived and/or modified sequence opt4 from neuraminidase__InfluenzaB__AGX17734

SEQ ID NO: 181786 - RNA, 1401 nt, Artificial Sequence
  derived and/or modified sequence opt4 from neuraminidase__InfluenzaB__AGX17745
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugcagcggcagcaccuuccagaaggcccugcugaucagcccccacagauucggcgagaucaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181787 - RNA, 1401 nt, Artificial Sequence
  derived and/or modified sequence opt4 from neuraminidase__InfluenzaB__AGX17756
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgccagacccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181788 - RNA, 1401 nt, Artificial Sequence; identical to SEQ ID NO: 181408
  derived and/or modified sequence opt4 from neuraminidase__InfluenzaB__AGX17767

SEQ ID NO: 181789 - RNA, 1401 nt, Artificial Sequence
  derived and/or modified sequence opt4 from neuraminidase__InfluenzaB__AGX17778
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgagagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181790 - RNA, 1401 nt, Artificial Sequence
  derived and/or modified sequence opt4 from neuraminidase__InfluenzaB__AGX17789
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181791 - RNA, 1401 nt, Artificial Sequence; identical to SEQ ID NO: 181361
  derived and/or modified sequence opt4 from neuraminidase__InfluenzaB__AGX17800

SEQ ID NO: 181792 - RNA, 1401 nt, Artificial Sequence
  derived and/or modified sequence opt4 from neuraminidase__InfluenzaB__AGX17811
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccaguga

SEQ ID NO: 181793 - RNA, 1401 nt, Artificial Sequence; identical to SEQ ID NO: 181774
  derived and/or modified sequence opt4 from neuraminidase__InfluenzaB__AGX17822

SEQ ID NO: 181794 - RNA, 1401 nt, Artificial Sequence
  derived and/or modified sequence opt4 from neuraminidase__InfluenzaB__AGX17833
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcaucaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181795 - RNA, 1401 nt, Artificial Sequence; identical to SEQ ID NO: 181781
  derived and/or modified sequence opt4 from neuraminidase__InfluenzaB__AGX17844

SEQ ID NO: 181796 - RNA, 1401 nt, Artificial Sequence; identical to SEQ ID NO: 181789
  derived and/or modified sequence opt4 from neuraminidase__InfluenzaB__AGX17855

SEQ ID NO: 181797 - RNA, 1401 nt, Artificial Sequence; identical to SEQ ID NO: 181408
  derived and/or modified sequence opt4 from neuraminidase__InfluenzaB__AGX17866

SEQ ID NO: 181798 - RNA, 1401 nt, Artificial Sequence; identical to SEQ ID NO: 181774
  derived and/or modified sequence opt4 from neuraminidase__InfluenzaB__AGX17877

SEQ ID NO: 181799 - RNA, 1401 nt, Artificial Sequence; identical to SEQ ID NO: 181781
  derived and/or modified sequence opt4 from neuraminidase__InfluenzaB__AGX17888

SEQ ID NO: 181800 - RNA, 1401 nt, Artificial Sequence; identical to SEQ ID NO: 181774
  derived and/or modified sequence opt4 from neuraminidase__InfluenzaB__AGX17899

SEQ ID NO: 181801 - RNA, 1401 nt, Artificial Sequence; identical to SEQ ID NO: 181781
  derived and/or modified sequence opt4 from neuraminidase__InfluenzaB__AGX17910

SEQ ID NO: 181802 - RNA, 1401 nt, Artificial Sequence; identical to SEQ ID NO: 181781
  derived and/or modified sequence opt4 from neuraminidase__InfluenzaB__AGX17921

SEQ ID NO: 181803 - RNA, 1401 nt, Artificial Sequence; identical to SEQ ID NO: 181408
  derived and/or modified sequence opt4 from neuraminidase__InfluenzaB__AGX17932

SEQ ID NO: 181804 - RNA, 1401 nt, Artificial Sequence
  derived and/or modified sequence opt4 from neuraminidase__InfluenzaB__AGX17943
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugagacugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181805 - RNA, 1401 nt, Artificial Sequence; identical to SEQ ID NO: 181774
  derived and/or modified sequence opt4 from neuraminidase__InfluenzaB__AGX17954

SEQ ID NO: 181806 - RNA, 1401 nt, Artificial Sequence
  derived and/or modified sequence opt4 from neuraminidase__InfluenzaB__AGX17976
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181807 - RNA, 1401 nt, Artificial Sequence
  derived and/or modified sequence opt4 from neuraminidase__InfluenzaB__AGX17987
augcugcccagcaccauccagacccugacccuguuccugaccagcggcggcgugcugcugagccuguacgugagcgugagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181808 - RNA, 1401 nt, Artificial Sequence; identical to SEQ ID NO: 181781
  derived and/or modified sequence opt4 from neuraminidase__InfluenzaB__AGX17998

SEQ ID NO: 181809 - RNA, 1401 nt, Artificial Sequence; identical to SEQ ID NO: 181774
  derived and/or modified sequence opt4 from neuraminidase__InfluenzaB__AGX18009

SEQ ID NO: 181810 - RNA, 1401 nt, Artificial Sequence; identical to SEQ ID NO: 181807
  derived and/or modified sequence opt4 from neuraminidase__InfluenzaB__AGX18020

SEQ ID NO: 181811 - RNA, 1401 nt, Artificial Sequence; identical to SEQ ID NO: 181774
  derived and/or modified sequence opt4 from neuraminidase__InfluenzaB__AGX18031

SEQ ID NO: 181812 - RNA, 1401 nt, Artificial Sequence
  derived and/or modified sequence opt4 from neuraminidase__InfluenzaB__AGX18042
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccugaacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181813 - RNA, 1401 nt, Artificial Sequence; identical to SEQ ID NO: 181781
  derived and/or modified sequence opt4 from neuraminidase__InfluenzaB__AGX18053

SEQ ID NO: 181814 - RNA, 1401 nt, Artificial Sequence; identical to SEQ ID NO: 181781
  derived and/or modified sequence opt4 from neuraminidase__InfluenzaB__AGX18064

SEQ ID NO: 181815 - RNA, 1401 nt, Artificial Sequence
  derived and/or modified sequence opt4 from neuraminidase__InfluenzaB__AGX18075
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcagcugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181816 - RNA, 1401 nt, Artificial Sequence; identical to SEQ ID NO: 181408
  derived and/or modified sequence opt4 from neuraminidase__InfluenzaB__AGX18086

SEQ ID NO: 181817 - RNA, 1401 nt, Artificial Sequence; identical to SEQ ID NO: 181408
  derived and/or modified sequence opt4 from neuraminidase__InfluenzaB__AGX18097

SEQ ID NO: 181818 - RNA, 1401 nt, Artificial Sequence; identical to SEQ ID NO: 181361
  derived and/or modified sequence opt4 from neuraminidase__InfluenzaB__AGX18108

SEQ ID NO: 181819 - RNA, 1401 nt, Artificial Sequence
  derived and/or modified sequence opt4 from neuraminidase__InfluenzaB__AGX18119
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacaccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacauggagaccgacaccgccgagaucaagcugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181820 - RNA, 1401 nt, Artificial Sequence
  derived and/or modified sequence opt4 from neuraminidase__InfluenzaB__AGX18130
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcagaaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181821 - RNA, 1401 nt, Artificial Sequence
  derived and/or modified sequence opt4 from neuraminidase__InfluenzaB__AGX18141
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcaugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgagagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181822 - RNA, 1401 nt, Artificial Sequence; identical to SEQ ID NO: 181408
  derived and/or modified sequence opt4 from neuraminidase__InfluenzaB__AGX18152

SEQ ID NO: 181823 - RNA, 1401 nt, Artificial Sequence
  derived and/or modified sequence opt4 from neuraminidase__InfluenzaB__AGX18163
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaagagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181824 - RNA, 1401 nt, Artificial Sequence; identical to SEQ ID NO: 181774
  derived and/or modified sequence opt4 from neuraminidase__InfluenzaB__AGX18174

SEQ ID NO: 181825 - RNA, 1401 nt, Artificial Sequence; identical to SEQ ID NO: 181408
  derived and/or modified sequence opt4 from neuraminidase__InfluenzaB__AGX18185

SEQ ID NO: 181826 - RNA, 1401 nt, Artificial Sequence; identical to SEQ ID NO: 181361
  derived and/or modified sequence opt4 from neuraminidase__InfluenzaB__AGX18196

SEQ ID NO: 181827 - RNA, 1401 nt, Artificial Sequence
  derived and/or modified sequence opt4 from neuraminidase__InfluenzaB__AGX18207
augcugcccagcaccauccagacccugacccuguuccugaccagcggcggcgugcugcugagccuguacgugagcgccagccugagcuaccugcuguacagcgacauccugcugaaguucccccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaccagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181828 - RNA, 1401 nt, Artificial Sequence
  derived and/or modified sequence opt4 from neuraminidase__InfluenzaB__AGX18218
augcugcccagcaccauccagacccugacccuguuccugaccagcggcggcgugcugcugagccuguacgugagcgccagccugagcuaccugcuguacagcgacauccugcugaagcugagccccaccgagaucaccgcccccaccaugccccuggacugcgccaacaccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacagaaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacauggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181829 - RNA, 1401 nt, Artificial Sequence; identical to SEQ ID NO: 181781
  derived and/or modified sequence opt4 from neuraminidase__InfluenzaB__AGX18229

SEQ ID NO: 181830 - RNA, 1401 nt, Artificial Sequence
  derived and/or modified sequence opt4 from neuraminidase__InfluenzaB__AGX18240
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcagaccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181831 - RNA, 1401 nt, Artificial Sequence; identical to SEQ ID NO: 181774
  derived and/or modified sequence opt4 from neuraminidase__InfluenzaB__AGX18251

SEQ ID NO: 181832 - RNA, 1401 nt, Artificial Sequence
  derived and/or modified sequence opt4 from neuraminidase__InfluenzaB__AGX18262
augcugcccagcaccauccagacccugacccuguuccugaccagcggcggcgugcugcugagccuguacgugagcgccagccugagcuaccugcuguacagcaacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaaggugggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181833 - RNA, 1401 nt, Artificial Sequence; identical to SEQ ID NO: 181781
  derived and/or modified sequence opt4 from neuraminidase__InfluenzaB__AGX18273

SEQ ID NO: 181834 - RNA, 1401 nt, Artificial Sequence; identical to SEQ ID NO: 181806
  derived and/or modified sequence opt4 from neuraminidase__InfluenzaB__AGX18284

SEQ ID NO: 181835 - RNA, 1401 nt, Artificial Sequence; identical to SEQ ID NO: 181781
  derived and/or modified sequence opt4 from neuraminidase__InfluenzaB__AGX18295

SEQ ID NO: 181836 - RNA, 1401 nt, Artificial Sequence; identical to SEQ ID NO: 181408
  derived and/or modified sequence opt4 from neuraminidase__InfluenzaB__AGX18306

SEQ ID NO: 181837 - RNA, 1401 nt, Artificial Sequence
  derived and/or modified sequence opt4 from neuraminidase__InfluenzaB__AGX18317
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacgagaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181838 - RNA, 1401 nt, Artificial Sequence; identical to SEQ ID NO: 181781
  derived and/or modified sequence opt4 from neuraminidase__InfluenzaB__AGX18328

SEQ ID NO: 181839 - RNA, 1401 nt, Artificial Sequence
  derived and/or modified sequence opt4 from neuraminidase__InfluenzaB__AGX18339
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaaggugggcagaugguacagcagaaccaugagcaagaccgagagaaugggcaugggccuguacgugaaguacgacggcgaccccugggccgacagcgacgcccuggccuucggcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181840 - RNA, 1401 nt, Artificial Sequence
  derived and/or modified sequence opt4 from neuraminidase__InfluenzaB__AGX18350
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccaugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181841 - RNA, 1401 nt, Artificial Sequence; identical to SEQ ID NO: 181806
  derived and/or modified sequence opt4 from neuraminidase__InfluenzaB__AGX18361

SEQ ID NO: 181842 - RNA, 1401 nt, Artificial Sequence
  derived and/or modified sequence opt4 from neuraminidase__InfluenzaB__AGX18383
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacaccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacauggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacggcggcggcaaggagaccuggcacagcgccgccaccgccaucuacugccugaugggcagcggccagcugcugugggacaccgugaccggcguggacauggcccuguga

SEQ ID NO: 181843 - RNA, 1401 nt, Artificial Sequence; identical to SEQ ID NO: 181408
  derived and/or modified sequence opt4 from neuraminidase__InfluenzaB__AGX18394

SEQ ID NO: 181844 - RNA, 1401 nt, Artificial Sequence
  derived and/or modified sequence opt4 from neuraminidase__InfluenzaB__AGX18405
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgugugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181845 - RNA, 1401 nt, Artificial Sequence
  derived and/or modified sequence opt4 from neuraminidase__InfluenzaB__AGX18416
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggcagcugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181846 - RNA, 1401 nt, Artificial Sequence
  derived and/or modified sequence opt4 from neuraminidase__InfluenzaB__AGX18428
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181847 - RNA, 1401 nt, Artificial Sequence
  derived and/or modified sequence opt4 from neuraminidase__InfluenzaB__AGX18439
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggccugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181848 - RNA, 1401 nt, Artificial Sequence
  derived and/or modified sequence opt4 from neuraminidase__InfluenzaB__AGX18450
augcugcccagcaccauccagacccugacccuguuccugaccagcggcggcgugcugcugagccuguacgugagcgccagccugagcuaccugcuguacagcgacauccugcugaaguucagccccaccgagaucaccgccagcaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaucgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181849 - RNA, 1401 nt, Artificial Sequence; identical to SEQ ID NO: 181408
  derived and/or modified sequence opt4 from neuraminidase__InfluenzaB__AGX18461

SEQ ID NO: 181850 - RNA, 1401 nt, Artificial Sequence
  derived and/or modified sequence opt4 from neuraminidase__InfluenzaB__AGX18472
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaaccacagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181851 - RNA, 1401 nt, Artificial Sequence; identical to SEQ ID NO: 181408
  derived and/or modified sequence opt4 from neuraminidase__InfluenzaB__AGX18483

SEQ ID NO: 181852 - RNA, 1401 nt, Artificial Sequence; identical to SEQ ID NO: 181155
  derived and/or modified sequence opt4 from neuraminidase__InfluenzaB__AGX18494

SEQ ID NO: 181853 - RNA, 1401 nt, Artificial Sequence
  derived and/or modified sequence opt4 from neuraminidase__InfluenzaB__AGX18505
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaucagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181854 - RNA, 1401 nt, Artificial Sequence
  derived and/or modified sequence opt4 from neuraminidase__InfluenzaB__AGX18516
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaucagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacggcggcggcaaggagaccuggcacagcgccgccaccgccaucuacugccugaugggcagcggccagcugcugugggacaccgugaccggcguggacauggcccuguga

SEQ ID NO: 181855 - RNA, 1401 nt, Artificial Sequence; identical to SEQ ID NO: 181155
  derived and/or modified sequence opt4 from neuraminidase__InfluenzaB__AGX18527

SEQ ID NO: 181856 - RNA, 1401 nt, Artificial Sequence; identical to SEQ ID NO: 181155
  derived and/or modified sequence opt4 from neuraminidase__InfluenzaB__AGX18538

SEQ ID NO: 181857 - RNA, 1401 nt, Artificial Sequence; identical to SEQ ID NO: 181155
  derived and/or modified sequence opt4 from neuraminidase__InfluenzaB__AGX18549

SEQ ID NO: 181858 - RNA, 1401 nt, Artificial Sequence; identical to SEQ ID NO: 181155
  derived and/or modified sequence opt4 from neuraminidase__InfluenzaB__AGX18560

SEQ ID NO: 181859 - RNA, 1401 nt, Artificial Sequence; identical to SEQ ID NO: 181155
  derived and/or modified sequence opt4 from neuraminidase__InfluenzaB__AGX18571

SEQ ID NO: 181860 - RNA, 1401 nt, Artificial Sequence
  derived and/or modified sequence opt4 from neuraminidase__InfluenzaB__AGX18582
augcugcccagcaccauccagacccugacccuguuccugaccagcggcggcgugcugcugagccuguacgugcuggccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgagugggccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181861 - RNA, 1401 nt, Artificial Sequence; identical to SEQ ID NO: 181155
  derived and/or modified sequence opt4 from neuraminidase__InfluenzaB__AGX18593

SEQ ID NO: 181862 - RNA, 1401 nt, Artificial Sequence; identical to SEQ ID NO: 181155
  derived and/or modified sequence opt4 from neuraminidase__InfluenzaB__AGX18604

SEQ ID NO: 181863 - RNA, 1401 nt, Artificial Sequence
  derived and/or modified sequence opt4 from neuraminidase__InfluenzaB__AGX18615
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181864 - RNA, 1401 nt, Artificial Sequence
  derived and/or modified sequence opt4 from neuraminidase__InfluenzaB__AGX18626
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugauccugagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181865 - RNA, 1401 nt, Artificial Sequence; identical to SEQ ID NO: 181155
  derived and/or modified sequence opt4 from neuraminidase__InfluenzaB__AGX18637

SEQ ID NO: 181866 - RNA, 1401 nt, Artificial Sequence; identical to SEQ ID NO: 181155
  derived and/or modified sequence opt4 from neuraminidase__InfluenzaB__AGX18648

SEQ ID NO: 181867 - RNA, 1401 nt, Artificial Sequence; identical to SEQ ID NO: 181155
  derived and/or modified sequence opt4 from neuraminidase__InfluenzaB__AGX18659

SEQ ID NO: 181868 - RNA, 1401 nt, Artificial Sequence; identical to SEQ ID NO: 181155
  derived and/or modified sequence opt4 from neuraminidase__InfluenzaB__AGX18670

SEQ ID NO: 181869 - RNA, 1401 nt, Artificial Sequence
  derived and/or modified sequence opt4 from neuraminidase__InfluenzaB__AGX18681
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucgugagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181870 - RNA, 1401 nt, Artificial Sequence; identical to SEQ ID NO: 181155
  derived and/or modified sequence opt4 from neuraminidase__InfluenzaB__AGX18692

SEQ ID NO: 181871 - RNA, 1401 nt, Artificial Sequence
  derived and/or modified sequence opt4 from neuraminidase__InfluenzaB__AGX18703
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaaccugagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181872 - RNA, 1401 nt, Artificial Sequence; identical to SEQ ID NO: 181155
  derived and/or modified sequence opt4 from neuraminidase__InfluenzaB__AGX18714

SEQ ID NO: 181873 - RNA, 1401 nt, Artificial Sequence; identical to SEQ ID NO: 181155
  derived and/or modified sequence opt4 from neuraminidase__InfluenzaB__AGX18725

SEQ ID NO: 181874 - RNA, 1401 nt, Artificial Sequence
  derived and/or modified sequence opt4 from neuraminidase__InfluenzaB__AGX18736
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccggcggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181875 - RNA, 1401 nt, Artificial Sequence; identical to SEQ ID NO: 181155
  derived and/or modified sequence opt4 from neuraminidase__InfluenzaB__AGX18758

SEQ ID NO: 181876 - RNA, 1401 nt, Artificial Sequence; identical to SEQ ID NO: 181155
  derived and/or modified sequence opt4 from neuraminidase__InfluenzaB__AGX18769

SEQ ID NO: 181877 - RNA, 1401 nt, Artificial Sequence; identical to SEQ ID NO: 181614
  derived and/or modified sequence opt4 from neuraminidase__InfluenzaB__AGX18780

SEQ ID NO: 181878 - RNA, 1401 nt, Artificial Sequence; identical to SEQ ID NO: 181155
  derived and/or modified sequence opt4 from neuraminidase__InfluenzaB__AGX18791

SEQ ID NO: 181879 - RNA, 1401 nt, Artificial Sequence; identical to SEQ ID NO: 181155
  derived and/or modified sequence opt4 from neuraminidase__InfluenzaB__AGX18802

SEQ ID NO: 181880 - RNA, 1401 nt, Artificial Sequence
  derived and/or modified sequence opt4 from neuraminidase__InfluenzaB__AGX18813
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugguguucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181881 - RNA, 1401 nt, Artificial Sequence; identical to SEQ ID NO: 181614
  derived and/or modified sequence opt4 from neuraminidase__InfluenzaB__AGX18824

SEQ ID NO: 181882 - RNA, 1401 nt, Artificial Sequence
  derived and/or modified sequence opt4 from neuraminidase__InfluenzaB__AGX18846
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugagcgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181883 - RNA, 1401 nt, Artificial Sequence; identical to SEQ ID NO: 181155
  derived and/or modified sequence opt4 from neuraminidase__InfluenzaB__AGX18857

SEQ ID NO: 181884 - RNA, 1401 nt, Artificial Sequence; identical to SEQ ID NO: 181882
  derived and/or modified sequence opt4 from neuraminidase__InfluenzaB__AGX18868

SEQ ID NO: 181885 - RNA, 1401 nt, Artificial Sequence; identical to SEQ ID NO: 181882
  derived and/or modified sequence opt4 from neuraminidase__InfluenzaB__AGX18879

SEQ ID NO: 181886 - RNA, 1401 nt, Artificial Sequence
  derived and/or modified sequence opt4 from neuraminidase__InfluenzaB__AGX18890
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccaccaucuacugccugaugggcagcggccagcugcugugggacaccgugaccggcgugaacauggcccuguga

SEQ ID NO: 181887 - RNA, 1401 nt, Artificial Sequence; identical to SEQ ID NO: 181155
  derived and/or modified sequence opt4 from neuraminidase__InfluenzaB__AGX18912

SEQ ID NO: 181888 - RNA, 1401 nt, Artificial Sequence
  derived and/or modified sequence opt4 from neuraminidase__InfluenzaB__AGX18923
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacagaaccagaggcgacagaaacaagcugagacaccugaucagcgugaagcugggcaagauccccaccguggagaacagcaucuuccacauggccgccuggagcggcagcgccugccacgacggcaaggaguggaucuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181889 - RNA, 1401 nt, Artificial Sequence; identical to SEQ ID NO: 181155
  derived and/or modified sequence opt4 from neuraminidase__InfluenzaB__AGX18934

SEQ ID NO: 181890 - RNA, 1401 nt, Artificial Sequence
  derived and/or modified sequence opt4 from neuraminidase__InfluenzaB__AGX18956
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacguggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181891 - RNA, 1401 nt, Artificial Sequence
  derived and/or modified sequence opt4 from neuraminidase__InfluenzaB__AGX18967
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181892 - RNA, 1401 nt, Artificial Sequence; identical to SEQ ID NO: 181614
  derived and/or modified sequence opt4 from neuraminidase__InfluenzaB__AGX18978

SEQ ID NO: 181893 - RNA, 1401 nt, Artificial Sequence
  derived and/or modified sequence opt4 from neuraminidase__InfluenzaB__AGX18989
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacuacgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaccaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181894 - RNA, 1401 nt, Artificial Sequence
  derived and/or modified sequence opt4 from neuraminidase__InfluenzaB__AGX19000
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugaccuacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181895 - RNA, 1401 nt, Artificial Sequence; identical to SEQ ID NO: 181155
  derived and/or modified sequence opt4 from neuraminidase__InfluenzaB__AGX19011

SEQ ID NO: 181896 - RNA, 1401 nt, Artificial Sequence; identical to SEQ ID NO: 181155
  derived and/or modified sequence opt4 from neuraminidase__InfluenzaB__AGX19022

SEQ ID NO: 181897 - RNA, 1401 nt, Artificial Sequence
  derived and/or modified sequence opt4 from neuraminidase__InfluenzaB__AGX19033
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccugaacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcgagggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181898 - RNA, 1401 nt, Artificial Sequence; identical to SEQ ID NO: 181155
  derived and/or modified sequence opt4 from neuraminidase__InfluenzaB__AGX19044

SEQ ID NO: 181899 - RNA, 1401 nt, Artificial Sequence; identical to SEQ ID NO: 181155
  derived and/or modified sequence opt4 from neuraminidase__InfluenzaB__AGX19055

SEQ ID NO: 181900 - RNA, 1401 nt, Artificial Sequence
  derived and/or modified sequence opt4 from neuraminidase__InfluenzaB__AGX19066
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaucuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181901 - RNA, 1401 nt, Artificial Sequence
  derived and/or modified sequence opt4 from neuraminidase__InfluenzaB__AGX19077
augcugcccagcaccauccagacccugacccuguuccugaccagcggcggcgugcugcugagccuguacgugagcgccagccugagcuaccugcuguacagcgacauccugcugaaguucacccccaccgagaucaccgcccccaccaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181902 - RNA, 1401 nt, Artificial Sequence
  derived and/or modified sequence opt4 from neuraminidase__InfluenzaB__AGX19088
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucgugaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181903 - RNA, 1401 nt, Artificial Sequence; identical to SEQ ID NO: 181155
  derived and/or modified sequence opt4 from neuraminidase__InfluenzaB__AGX19099

SEQ ID NO: 181904 - RNA, 1401 nt, Artificial Sequence
  derived and/or modified sequence opt4 from neuraminidase__InfluenzaB__AGX19110
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucaucaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccugguguucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181905 - RNA, 1401 nt, Artificial Sequence
  derived and/or modified sequence opt4 from neuraminidase__InfluenzaB__AGX19121
augcugcccagcaccacccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181906 - RNA, 1401 nt, Artificial Sequence; identical to SEQ ID NO: 181789
  derived and/or modified sequence opt4 from neuraminidase__InfluenzaB__AGX19132

SEQ ID NO: 181907 - RNA, 1401 nt, Artificial Sequence; identical to SEQ ID NO: 181893
  derived and/or modified sequence opt4 from neuraminidase__InfluenzaB__AGX19143

SEQ ID NO: 181908 - RNA, 1401 nt, Artificial Sequence
  derived and/or modified sequence opt4 from neuraminidase__InfluenzaB__AGX19154
augcugcccagcaccauccagacccugacccuguuccugaccagcggcggcgugcugcugagccuguacgugagcgccagccugagcuaccugcuguacagcaacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181909 - RNA, 1401 nt, Artificial Sequence; identical to SEQ ID NO: 181155
  derived and/or modified sequence opt4 from neuraminidase__InfluenzaB__AGX19165

SEQ ID NO: 181910 - RNA, 1401 nt, Artificial Sequence
  derived and/or modified sequence opt4 from neuraminidase__InfluenzaB__AGX19176
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacagaaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181911 - RNA, 1401 nt, Artificial Sequence
  derived and/or modified sequence opt4 from neuraminidase__InfluenzaB__AGX19187
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugcagcggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181912 - RNA, 1401 nt, Artificial Sequence
  derived and/or modified sequence opt4 from neuraminidase__InfluenzaB__AGX19198
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacuacgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181913 - RNA, 1401 nt, Artificial Sequence; identical to SEQ ID NO: 181893
  derived and/or modified sequence opt4 from neuraminidase__InfluenzaB__AGX19209

SEQ ID NO: 181914 - RNA, 1401 nt, Artificial Sequence
  derived and/or modified sequence opt4 from neuraminidase__InfluenzaB__AGX19220
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugagccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacagaggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181915 - RNA, 1401 nt, Artificial Sequence; identical to SEQ ID NO: 181361
  derived and/or modified sequence opt4 from neuraminidase__InfluenzaB__AGX19231

SEQ ID NO: 181916 - RNA, 1401 nt, Artificial Sequence
  derived and/or modified sequence opt4 from neuraminidase__InfluenzaB__AGX19253
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacagccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181917 - RNA, 1401 nt, Artificial Sequence; identical to SEQ ID NO: 181891
  derived and/or modified sequence opt4 from neuraminidase__InfluenzaB__AGX19264

SEQ ID NO: 181918 - RNA, 1401 nt, Artificial Sequence; identical to SEQ ID NO: 181155
  derived and/or modified sequence opt4 from neuraminidase__InfluenzaB__AGX19275

SEQ ID NO: 181919 - RNA, 1401 nt, Artificial Sequence
  derived and/or modified sequence opt4 from neuraminidase__InfluenzaB__AGX19286
augauccccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181920 - RNA, 1401 nt, Artificial Sequence
  derived and/or modified sequence opt4 from neuraminidase__InfluenzaB__AGX19297
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181921 - RNA, 1401 nt, Artificial Sequence; identical to SEQ ID NO: 181920
  derived and/or modified sequence opt4 from neuraminidase__InfluenzaB__AGX19308

SEQ ID NO: 181922 - RNA, 1401 nt, Artificial Sequence; identical to SEQ ID NO: 181920
  derived and/or modified sequence opt4 from neuraminidase__InfluenzaB__AGX19319

SEQ ID NO: 181923 - RNA, 1401 nt, Artificial Sequence
  derived and/or modified sequence opt4 from neuraminidase__InfluenzaB__AGX19330
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcaacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181924 - RNA, 1401 nt, Artificial Sequence; identical to SEQ ID NO: 181920
  derived and/or modified sequence opt4 from neuraminidase__InfluenzaB__AGX19341

SEQ ID NO: 181925 - RNA, 1401 nt, Artificial Sequence; identical to SEQ ID NO: 181920
  derived and/or modified sequence opt4 from neuraminidase__InfluenzaB__AGX19352

SEQ ID NO: 181926 - RNA, 1401 nt, Artificial Sequence
  derived and/or modified sequence opt4 from neuraminidase__InfluenzaB__AGX19363
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugaccuacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181927 - RNA, 1401 nt, Artificial Sequence
  derived and/or modified sequence opt4 from neuraminidase__InfluenzaB__AGX19374
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugagcgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181928 - RNA, 1401 nt, Artificial Sequence; identical to SEQ ID NO: 181920
  derived and/or modified sequence opt4 from neuraminidase__InfluenzaB__AGX19385

SEQ ID NO: 181929 - RNA, 1401 nt, Artificial Sequence
  derived and/or modified sequence opt4 from neuraminidase__InfluenzaB__AGX19396
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggccccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181930 - RNA, 1401 nt, Artificial Sequence; identical to SEQ ID NO: 181920
  derived and/or modified sequence opt4 from neuraminidase__InfluenzaB__AGX19407

SEQ ID NO: 181931 - RNA, 1401 nt, Artificial Sequence; identical to SEQ ID NO: 181481
  derived and/or modified sequence opt4 from neuraminidase__InfluenzaB__AGX19418

SEQ ID NO: 181932 - RNA, 1401 nt, Artificial Sequence
  derived and/or modified sequence opt4 from neuraminidase__InfluenzaB__AGX19429
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 181933 - RNA, 1401 nt, Artificial Sequence
  derived and/or modified sequence opt4 from neuraminidase__InfluenzaB__AGX19451
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181934 - RNA, 1401 nt, Artificial Sequence; identical to SEQ ID NO: 181932
  derived and/or modified sequence opt4 from neuraminidase__InfluenzaB__AGX19462

SEQ ID NO: 181935 - RNA, 1401 nt, Artificial Sequence; identical to SEQ ID NO: 181932
  derived and/or modified sequence opt4 from neuraminidase__InfluenzaB__AGX19473

SEQ ID NO: 181936 - RNA, 1401 nt, Artificial Sequence; identical to SEQ ID NO: 181481
  derived and/or modified sequence opt4 from neuraminidase__InfluenzaB__AGX19484

SEQ ID NO: 181937 - RNA, 1401 nt, Artificial Sequence; identical to SEQ ID NO: 181933
  derived and/or modified sequence opt4 from neuraminidase__InfluenzaB__AGX19495

SEQ ID NO: 181938 - RNA, 1401 nt, Artificial Sequence; identical to SEQ ID NO: 181481
  derived and/or modified sequence opt4 from neuraminidase__InfluenzaB__AGX19506

SEQ ID NO: 181939 - RNA, 1401 nt, Artificial Sequence; identical to SEQ ID NO: 181481
  derived and/or modified sequence opt4 from neuraminidase__InfluenzaB__AGX19517

SEQ ID NO: 181940 - RNA, 1401 nt, Artificial Sequence; identical to SEQ ID NO: 181481
  derived and/or modified sequence opt4 from neuraminidase__InfluenzaB__AGX19528

SEQ ID NO: 181941 - RNA, 1401 nt, Artificial Sequence; identical to SEQ ID NO: 181933
  derived and/or modified sequence opt4 from neuraminidase__InfluenzaB__AGX19539

SEQ ID NO: 181942 - RNA, 1401 nt, Artificial Sequence
  derived and/or modified sequence opt4 from neuraminidase__InfluenzaB__AGX19550
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaacgagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181943 - RNA, 1401 nt, Artificial Sequence
  derived and/or modified sequence opt4 from neuraminidase__InfluenzaB__AGX19561
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccagaggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181944 - RNA, 1401 nt, Artificial Sequence
  derived and/or modified sequence opt4 from neuraminidase__InfluenzaB__AGX19572
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181945 - RNA, 1401 nt, Artificial Sequence; identical to SEQ ID NO: 181481
  derived and/or modified sequence opt4 from neuraminidase__InfluenzaB__AGX19583

SEQ ID NO: 181946 - RNA, 1401 nt, Artificial Sequence; identical to SEQ ID NO: 181481
  derived and/or modified sequence opt4 from neuraminidase__InfluenzaB__AGX19594

SEQ ID NO: 181947 - RNA, 1401 nt, Artificial Sequence; identical to SEQ ID NO: 181481
  derived and/or modified sequence opt4 from neuraminidase__InfluenzaB__AGX19605

SEQ ID NO: 181948 - RNA, 1401 nt, Artificial Sequence; identical to SEQ ID NO: 181481
  derived and/or modified sequence opt4 from neuraminidase__InfluenzaB__AGX19616

SEQ ID NO: 181949 - RNA, 1401 nt, Artificial Sequence; identical to SEQ ID NO: 181933
  derived and/or modified sequence opt4 from neuraminidase__InfluenzaB__AGX19627

SEQ ID NO: 181950 - RNA, 1401 nt, Artificial Sequence; identical to SEQ ID NO: 181481
  derived and/or modified sequence opt4 from neuraminidase__InfluenzaB__AGX19638

SEQ ID NO: 181951 - RNA, 1401 nt, Artificial Sequence; identical to SEQ ID NO: 181933
  derived and/or modified sequence opt4 from neuraminidase__InfluenzaB__AGX19649

SEQ ID NO: 181952 - RNA, 1401 nt, Artificial Sequence; identical to SEQ ID NO: 181933
  derived and/or modified sequence opt4 from neuraminidase__InfluenzaB__AGX19660

SEQ ID NO: 181953 - RNA, 1401 nt, Artificial Sequence; identical to SEQ ID NO: 181481
  derived and/or modified sequence opt4 from neuraminidase__InfluenzaB__AGX19671

SEQ ID NO: 181954 - RNA, 1401 nt, Artificial Sequence; identical to SEQ ID NO: 181481
  derived and/or modified sequence opt4 from neuraminidase__InfluenzaB__AGX19682

SEQ ID NO: 181955 - RNA, 1401 nt, Artificial Sequence; identical to SEQ ID NO: 181933
  derived and/or modified sequence opt4 from neuraminidase__InfluenzaB__AGX19704

SEQ ID NO: 181956 - RNA, 1401 nt, Artificial Sequence
  derived and/or modified sequence opt4 from neuraminidase__InfluenzaB__AGX19715
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcaccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181957 - RNA, 1401 nt, Artificial Sequence; identical to SEQ ID NO: 181481
  derived and/or modified sequence opt4 from neuraminidase__InfluenzaB__AGX19726

SEQ ID NO: 181958 - RNA, 1401 nt, Artificial Sequence; identical to SEQ ID NO: 181481
  derived and/or modified sequence opt4 from neuraminidase__InfluenzaB__AGX19737

SEQ ID NO: 181959 - RNA, 1401 nt, Artificial Sequence; identical to SEQ ID NO: 181481
  derived and/or modified sequence opt4 from neuraminidase__InfluenzaB__AGX19748

SEQ ID NO: 181960 - RNA, 1401 nt, Artificial Sequence; identical to SEQ ID NO: 181933
  derived and/or modified sequence opt4 from neuraminidase__InfluenzaB__AGX19759

SEQ ID NO: 181961 - RNA, 1401 nt, Artificial Sequence; identical to SEQ ID NO: 181481
  derived and/or modified sequence opt4 from neuraminidase__InfluenzaB__AGX19770

SEQ ID NO: 181962 - RNA, 1401 nt, Artificial Sequence; identical to SEQ ID NO: 181481
  derived and/or modified sequence opt4 from neuraminidase__InfluenzaB__AGX19781

SEQ ID NO: 181963 - RNA, 1401 nt, Artificial Sequence; identical to SEQ ID NO: 181481
  derived and/or modified sequence opt4 from neuraminidase__InfluenzaB__AGX19792

SEQ ID NO: 181964 - RNA, 1401 nt, Artificial Sequence; identical to SEQ ID NO: 181481
  derived and/or modified sequence opt4 from neuraminidase__InfluenzaB__AGX19803

SEQ ID NO: 181965 - RNA, 1401 nt, Artificial Sequence; identical to SEQ ID NO: 181481
  derived and/or modified sequence opt4 from neuraminidase__InfluenzaB__AGX19814

SEQ ID NO: 181966 - RNA, 1401 nt, Artificial Sequence
  derived and/or modified sequence opt4 from neuraminidase__InfluenzaB__AGX19825
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccaacaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181967 - RNA, 1401 nt, Artificial Sequence; identical to SEQ ID NO: 181481
  derived and/or modified sequence opt4 from neuraminidase__InfluenzaB__AGX19836

SEQ ID NO: 181968 - RNA, 1401 nt, Artificial Sequence; identical to SEQ ID NO: 181481
  derived and/or modified sequence opt4 from neuraminidase__InfluenzaB__AGX19847

SEQ ID NO: 181969 - RNA, 1401 nt, Artificial Sequence; identical to SEQ ID NO: 181481
  derived and/or modified sequence opt4 from neuraminidase__InfluenzaB__AGX19858

SEQ ID NO: 181970 - RNA, 1401 nt, Artificial Sequence; identical to SEQ ID NO: 181481
  derived and/or modified sequence opt4 from neuraminidase__InfluenzaB__AGX19869

SEQ ID NO: 181971 - RNA, 1401 nt, Artificial Sequence; identical to SEQ ID NO: 181481
  derived and/or modified sequence opt4 from neuraminidase__InfluenzaB__AGX19880

SEQ ID NO: 181972 - RNA, 1401 nt, Artificial Sequence; identical to SEQ ID NO: 181481
  derived and/or modified sequence opt4 from neuraminidase__InfluenzaB__AGX19891

SEQ ID NO: 181973 - RNA, 1401 nt, Artificial Sequence; identical to SEQ ID NO: 181481
  derived and/or modified sequence opt4 from neuraminidase__InfluenzaB__AGX19902

SEQ ID NO: 181974 - RNA, 1401 nt, Artificial Sequence
  derived and/or modified sequence opt4 from neuraminidase__InfluenzaB__AGX19913
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccaugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181975 - RNA, 1401 nt, Artificial Sequence; identical to SEQ ID NO: 181481
  derived and/or modified sequence opt4 from neuraminidase__InfluenzaB__AGX19924

SEQ ID NO: 181976 - RNA, 1401 nt, Artificial Sequence; identical to SEQ ID NO: 181481
  derived and/or modified sequence opt4 from neuraminidase__InfluenzaB__AGX19935

SEQ ID NO: 181977 - RNA, 1401 nt, Artificial Sequence; identical to SEQ ID NO: 181481
  derived and/or modified sequence opt4 from neuraminidase__InfluenzaB__AGX19946

SEQ ID NO: 181978 - RNA, 1401 nt, Artificial Sequence; identical to SEQ ID NO: 181481
  derived and/or modified sequence opt4 from neuraminidase__InfluenzaB__AGX19957

SEQ ID NO: 181979 - RNA, 1401 nt, Artificial Sequence
  derived and/or modified sequence opt4 from neuraminidase__InfluenzaB__AGX19968
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181980 - RNA, 1401 nt, Artificial Sequence; identical to SEQ ID NO: 181933
  derived and/or modified sequence opt4 from neuraminidase__InfluenzaB__AGX19979

SEQ ID NO: 181981 - RNA, 1401 nt, Artificial Sequence; identical to SEQ ID NO: 181933
  derived and/or modified sequence opt4 from neuraminidase__InfluenzaB__AGX19990

SEQ ID NO: 181982 - RNA, 1401 nt, Artificial Sequence; identical to SEQ ID NO: 181481
  derived and/or modified sequence opt4 from neuraminidase__InfluenzaB__AGX20001

SEQ ID NO: 181983 - RNA, 1401 nt, Artificial Sequence; identical to SEQ ID NO: 181481
  derived and/or modified sequence opt4 from neuraminidase__InfluenzaB__AGX20012

SEQ ID NO: 181984 - RNA, 1401 nt, Artificial Sequence; identical to SEQ ID NO: 181481
  derived and/or modified sequence opt4 from neuraminidase__InfluenzaB__AGX20023

SEQ ID NO: 181985 - RNA, 1401 nt, Artificial Sequence; identical to SEQ ID NO: 181481
  derived and/or modified sequence opt4 from neuraminidase__InfluenzaB__AGX20034

SEQ ID NO: 181986 - RNA, 1401 nt, Artificial Sequence; identical to SEQ ID NO: 181481
  derived and/or modified sequence opt4 from neuraminidase__InfluenzaB__AGX20045

SEQ ID NO: 181987 - RNA, 1401 nt, Artificial Sequence
  derived and/or modified sequence opt4 from neuraminidase__InfluenzaB__AGX20056
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaugaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181988 - RNA, 1401 nt, Artificial Sequence
  derived and/or modified sequence opt4 from neuraminidase__InfluenzaB__AGX20067
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181989 - RNA, 1401 nt, Artificial Sequence; identical to SEQ ID NO: 181481
  derived and/or modified sequence opt4 from neuraminidase__InfluenzaB__AGX20078

SEQ ID NO: 181990 - RNA, 1401 nt, Artificial Sequence; identical to SEQ ID NO: 181481
  derived and/or modified sequence opt4 from neuraminidase__InfluenzaB__AGX20089

SEQ ID NO: 181991 - RNA, 1401 nt, Artificial Sequence
  derived and/or modified sequence opt4 from neuraminidase__InfluenzaB__AGX20100
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgccgugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaauccagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 181992 - RNA, 1401 nt, Artificial Sequence
  derived and/or modified sequence opt4 from neuraminidase__InfluenzaB__AGX20111
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181993 - RNA, 1401 nt, Artificial Sequence
  derived and/or modified sequence opt4 from neuraminidase__InfluenzaB__AGX20122
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagagagcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181994 - RNA, 1401 nt, Artificial Sequence
  derived and/or modified sequence opt4 from neuraminidase__InfluenzaB__AGX20133
augcugcccagcaccauccagacccugacccuguuccugaccagcggcggcgugcugcugagccuguacgugagcgcccugcugagcuaccugcuguacagcgacgugcugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181995 - RNA, 1401 nt, Artificial Sequence
  derived and/or modified sequence opt4 from neuraminidase__InfluenzaB__AGX20144
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 181996 - RNA, 1401 nt, Artificial Sequence; identical to SEQ ID NO: 181995
  derived and/or modified sequence opt4 from neuraminidase__InfluenzaB__AGX20155

SEQ ID NO: 181997 - RNA, 1401 nt, Artificial Sequence; identical to SEQ ID NO: 181995
  derived and/or modified sequence opt4 from neuraminidase__InfluenzaB__AGX20166

SEQ ID NO: 181998 - RNA, 1401 nt, Artificial Sequence; identical to SEQ ID NO: 181415
  derived and/or modified sequence opt4 from neuraminidase__InfluenzaB__AGX20177

SEQ ID NO: 181999 - RNA, 1401 nt, Artificial Sequence; identical to SEQ ID NO: 181415
  derived and/or modified sequence opt4 from neuraminidase__InfluenzaB__AGX20188

SEQ ID NO: 182000 - RNA, 1401 nt, Artificial Sequence; identical to SEQ ID NO: 181392
  derived and/or modified sequence opt4 from neuraminidase__InfluenzaB__AGX20199

SEQ ID NO: 182001 - RNA, 1401 nt, Artificial Sequence; identical to SEQ ID NO: 181415
  derived and/or modified sequence opt4 from neuraminidase__InfluenzaB__AGX20210

SEQ ID NO: 182002 - RNA, 1401 nt, Artificial Sequence; identical to SEQ ID NO: 181995
  derived and/or modified sequence opt4 from neuraminidase__InfluenzaB__AGX20221

SEQ ID NO: 182003 - RNA, 1401 nt, Artificial Sequence
  derived and/or modified sequence opt4 from neuraminidase__InfluenzaB__AGX20232
augcugcccagcaccauccagacccugacccuguuccugaccagcggcggcgugcugcugagccuguacgugagcgccagccugagcuaccugcuguacagcggcauccugcugaaguucagccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacgagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcggcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182004 - RNA, 1401 nt, Artificial Sequence; identical to SEQ ID NO: 181415
  derived and/or modified sequence opt4 from neuraminidase__InfluenzaB__AGX20243

SEQ ID NO: 182005 - RNA, 1401 nt, Artificial Sequence; identical to SEQ ID NO: 181995
  derived and/or modified sequence opt4 from neuraminidase__InfluenzaB__AGX20254

SEQ ID NO: 182006 - RNA, 1401 nt, Artificial Sequence; identical to SEQ ID NO: 181392
  derived and/or modified sequence opt4 from neuraminidase__InfluenzaB__AGX20265

SEQ ID NO: 182007 - RNA, 1401 nt, Artificial Sequence; identical to SEQ ID NO: 181995
  derived and/or modified sequence opt4 from neuraminidase__InfluenzaB__AGX20276

SEQ ID NO: 182008 - RNA, 1401 nt, Artificial Sequence; identical to SEQ ID NO: 181415
  derived and/or modified sequence opt4 from neuraminidase__InfluenzaB__AGX20287

SEQ ID NO: 182009 - RNA, 1401 nt, Artificial Sequence
  derived and/or modified sequence opt4 from neuraminidase__InfluenzaB__AGX20298
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcagagcgccgccaccgccaucuacugccugaugggcagcggccagcugcugugggacaccgugaccggcguggacauggcccuguga

SEQ ID NO: 182010 - RNA, 1401 nt, Artificial Sequence; identical to SEQ ID NO: 181392
  derived and/or modified sequence opt4 from neuraminidase__InfluenzaB__AGX20320

SEQ ID NO: 182011 - RNA, 1401 nt, Artificial Sequence; identical to SEQ ID NO: 181415
  derived and/or modified sequence opt4 from neuraminidase__InfluenzaB__AGX20331

SEQ ID NO: 182012 - RNA, 1401 nt, Artificial Sequence
  derived and/or modified sequence opt4 from neuraminidase__InfluenzaB__AGX20342
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182013 - RNA, 1401 nt, Artificial Sequence
  derived and/or modified sequence opt4 from neuraminidase__InfluenzaB__AGX20353
augcugcccagcaccauccagacccugacccuguuccugaccagcggcggcgugcugcugagccuguacgugagcgcccugcugagcuaccugcuguacagcgacauccugcugaaguucagccccaccgagaucaucgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacagaaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182014 - RNA, 1401 nt, Artificial Sequence; identical to SEQ ID NO: 181415
  derived and/or modified sequence opt4 from neuraminidase__InfluenzaB__AGX20364

SEQ ID NO: 182015 - RNA, 1401 nt, Artificial Sequence; identical to SEQ ID NO: 181410
  derived and/or modified sequence opt4 from neuraminidase__InfluenzaB__AGX20375

SEQ ID NO: 182016 - RNA, 1401 nt, Artificial Sequence
  derived and/or modified sequence opt4 from neuraminidase__InfluenzaB__AGX20386
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggacccaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182017 - RNA, 1401 nt, Artificial Sequence; identical to SEQ ID NO: 181415
  derived and/or modified sequence opt4 from neuraminidase__InfluenzaB__AGX20397

SEQ ID NO: 182018 - RNA, 1401 nt, Artificial Sequence; identical to SEQ ID NO: 181410
  derived and/or modified sequence opt4 from neuraminidase__InfluenzaB__AGX20408

SEQ ID NO: 182019 - RNA, 1401 nt, Artificial Sequence; identical to SEQ ID NO: 181392
  derived and/or modified sequence opt4 from neuraminidase__InfluenzaB__AGX20419

SEQ ID NO: 182020 - RNA, 1401 nt, Artificial Sequence
  derived and/or modified sequence opt4 from neuraminidase__InfluenzaB__AGX20430
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagagagcccugcugaucagcccccacagauucggcgaggccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182021 - RNA, 1401 nt, Artificial Sequence; identical to SEQ ID NO: 181392
  derived and/or modified sequence opt4 from neuraminidase__InfluenzaB__AGX20441

SEQ ID NO: 182022 - RNA, 1401 nt, Artificial Sequence
  derived and/or modified sequence opt4 from neuraminidase__InfluenzaB__AGX20452
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucagagacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182023 - RNA, 1401 nt, Artificial Sequence; identical to SEQ ID NO: 181415
  derived and/or modified sequence opt4 from neuraminidase__InfluenzaB__AGX20463

SEQ ID NO: 182024 - RNA, 1401 nt, Artificial Sequence; identical to SEQ ID NO: 181415
  derived and/or modified sequence opt4 from neuraminidase__InfluenzaB__AGX20474

SEQ ID NO: 182025 - RNA, 1401 nt, Artificial Sequence; identical to SEQ ID NO: 181415
  derived and/or modified sequence opt4 from neuraminidase__InfluenzaB__AGX20485

SEQ ID NO: 182026 - RNA, 1401 nt, Artificial Sequence; identical to SEQ ID NO: 181995
  derived and/or modified sequence opt4 from neuraminidase__InfluenzaB__AGX20496

SEQ ID NO: 182027 - RNA, 1401 nt, Artificial Sequence; identical to SEQ ID NO: 181415
  derived and/or modified sequence opt4 from neuraminidase__InfluenzaB__AGX20507

SEQ ID NO: 182028 - RNA, 1401 nt, Artificial Sequence; identical to SEQ ID NO: 181415
  derived and/or modified sequence opt4 from neuraminidase__InfluenzaB__AGX20518

SEQ ID NO: 182029 - RNA, 1401 nt, Artificial Sequence
  derived and/or modified sequence opt4 from neuraminidase__InfluenzaB__AGX20529
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcaccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182030 - RNA, 1401 nt, Artificial Sequence; identical to SEQ ID NO: 181993
  derived and/or modified sequence opt4 from neuraminidase__InfluenzaB__AGX20540

SEQ ID NO: 182031 - RNA, 1401 nt, Artificial Sequence; identical to SEQ ID NO: 181639
  derived and/or modified sequence opt4 from neuraminidase__InfluenzaB__AGX20551

SEQ ID NO: 182032 - RNA, 1401 nt, Artificial Sequence; identical to SEQ ID NO: 181392
  derived and/or modified sequence opt4 from neuraminidase__InfluenzaB__AGX20562

SEQ ID NO: 182033 - RNA, 1401 nt, Artificial Sequence; identical to SEQ ID NO: 181415
  derived and/or modified sequence opt4 from neuraminidase__InfluenzaB__AGX20573

SEQ ID NO: 182034 - RNA, 1401 nt, Artificial Sequence
  derived and/or modified sequence opt4 from neuraminidase__InfluenzaB__AGX20584
augcugcccagcaccauccagacccugacccuguuccugaccagcggcggcgugcugcugagccuguacgugagcgccagccugagcuaccugcuguacagcgacauccugcugaaguucagcagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcagaaucggcagaugguacagcagaaccaugagcaagaccgagagaaugggcaugggccuguacgugaaguacgacggcgaccccuggaccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182035 - RNA, 1401 nt, Artificial Sequence; identical to SEQ ID NO: 181415
  derived and/or modified sequence opt4 from neuraminidase__InfluenzaB__AGX20595

SEQ ID NO: 182036 - RNA, 1401 nt, Artificial Sequence; identical to SEQ ID NO: 181993
  derived and/or modified sequence opt4 from neuraminidase__InfluenzaB__AGX20606

SEQ ID NO: 182037 - RNA, 1401 nt, Artificial Sequence; identical to SEQ ID NO: 181993
  derived and/or modified sequence opt4 from neuraminidase__InfluenzaB__AGX20617

SEQ ID NO: 182038 - RNA, 1401 nt, Artificial Sequence; identical to SEQ ID NO: 182020
  derived and/or modified sequence opt4 from neuraminidase__InfluenzaB__AGX20628

SEQ ID NO: 182039 - RNA, 1401 nt, Artificial Sequence; identical to SEQ ID NO: 181420
  derived and/or modified sequence opt4 from neuraminidase__InfluenzaB__AGX20639

SEQ ID NO: 182040 - RNA, 1401 nt, Artificial Sequence
  derived and/or modified sequence opt4 from neuraminidase__InfluenzaB__AGX20650
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcaccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182041 - RNA, 1401 nt, Artificial Sequence
  derived and/or modified sequence opt4 from neuraminidase__InfluenzaB__AGX20661
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaaccugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccuggaccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182042 - RNA, 1401 nt, Artificial Sequence; identical to SEQ ID NO: 181476
  derived and/or modified sequence opt4 from neuraminidase__InfluenzaB__AGX20683

SEQ ID NO: 182043 - RNA, 1401 nt, Artificial Sequence; identical to SEQ ID NO: 181639
  derived and/or modified sequence opt4 from neuraminidase__InfluenzaB__AGX20694

SEQ ID NO: 182044 - RNA, 1401 nt, Artificial Sequence
  derived and/or modified sequence opt4 from neuraminidase__InfluenzaB__AGX20705
augcugcccagcaccauccagacccugacccuguuccugaccagcggcggcgugcugcugagccuguacgugagcgccagccugagcuaccugcuguacagcggcauccugcugaaguucagccccaccgagaucaccgcccccaccaugccccuggacugcgccaacgccagcgacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182045 - RNA, 1401 nt, Artificial Sequence
  derived and/or modified sequence opt4 from neuraminidase__InfluenzaB__AGX20716
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaucgagagcagaaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182046 - RNA, 1401 nt, Artificial Sequence
  derived and/or modified sequence opt4 from neuraminidase__InfluenzaB__AGX20727
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaccaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182047 - RNA, 1401 nt, Artificial Sequence; identical to SEQ ID NO: 181639
  derived and/or modified sequence opt4 from neuraminidase__InfluenzaB__AGX20738

SEQ ID NO: 182048 - RNA, 1401 nt, Artificial Sequence; identical to SEQ ID NO: 181415
  derived and/or modified sequence opt4 from neuraminidase__InfluenzaB__AGX20749

SEQ ID NO: 182049 - RNA, 1401 nt, Artificial Sequence
  derived and/or modified sequence opt4 from neuraminidase__InfluenzaB__AGX20760
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcagaaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182050 - RNA, 1401 nt, Artificial Sequence; identical to SEQ ID NO: 181415
  derived and/or modified sequence opt4 from neuraminidase__InfluenzaB__AGX20771

SEQ ID NO: 182051 - RNA, 1401 nt, Artificial Sequence
  derived and/or modified sequence opt4 from neuraminidase__InfluenzaB__AGX20782
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcagccacagauucggcgagaccaagggcaacagcgccccccugaucaucagagagcccuucguggccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcagaaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182052 - RNA, 1401 nt, Artificial Sequence
  derived and/or modified sequence opt4 from neuraminidase__InfluenzaB__AGX20793
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacaccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 182053 - RNA, 1401 nt, Artificial Sequence
  derived and/or modified sequence opt4 from neuraminidase__InfluenzaB__AGX20804
augcugcccagcaccauccagacccugacccuguucaucaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182054 - RNA, 1401 nt, Artificial Sequence; identical to SEQ ID NO: 181476
  derived and/or modified sequence opt4 from neuraminidase__InfluenzaB__AGX20815

SEQ ID NO: 182055 - RNA, 1401 nt, Artificial Sequence; identical to SEQ ID NO: 181476
  derived and/or modified sequence opt4 from neuraminidase__InfluenzaB__AGX20826

SEQ ID NO: 182056 - RNA, 1401 nt, Artificial Sequence; identical to SEQ ID NO: 181476
  derived and/or modified sequence opt4 from neuraminidase__InfluenzaB__AGX20837

SEQ ID NO: 182057 - RNA, 1401 nt, Artificial Sequence; identical to SEQ ID NO: 181476
  derived and/or modified sequence opt4 from neuraminidase__InfluenzaB__AGX20848

SEQ ID NO: 182058 - RNA, 1401 nt, Artificial Sequence
  derived and/or modified sequence opt4 from neuraminidase__InfluenzaB__AGX20870
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgagcccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182059 - RNA, 1401 nt, Artificial Sequence
  derived and/or modified sequence opt4 from neuraminidase__InfluenzaB__AGX20881
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcaacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182060 - RNA, 1401 nt, Artificial Sequence
  derived and/or modified sequence opt4 from neuraminidase__InfluenzaB__AGX20892
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagagagcccugcugaucagcccccacagauucggcgaggccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagauccugcccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182061 - RNA, 1401 nt, Artificial Sequence; identical to SEQ ID NO: 181476
  derived and/or modified sequence opt4 from neuraminidase__InfluenzaB__AGX20903

SEQ ID NO: 182062 - RNA, 1401 nt, Artificial Sequence; identical to SEQ ID NO: 181476
  derived and/or modified sequence opt4 from neuraminidase__InfluenzaB__AGX20914

SEQ ID NO: 182063 - RNA, 1401 nt, Artificial Sequence
  derived and/or modified sequence opt4 from neuraminidase__InfluenzaB__AGX20925
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagauccaggagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182064 - RNA, 1401 nt, Artificial Sequence
  derived and/or modified sequence opt4 from neuraminidase__InfluenzaB__AGX20936
augcugcccagcaccauccagacccugacccuguuccugaccagcggcggcgugcugcugagccuguacgugagcgcccugcugagcuaccugcuguacagcgacauccugcccaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182065 - RNA, 1401 nt, Artificial Sequence; identical to SEQ ID NO: 181415
  derived and/or modified sequence opt4 from neuraminidase__InfluenzaB__AGX20947

SEQ ID NO: 182066 - RNA, 1401 nt, Artificial Sequence
  derived and/or modified sequence opt4 from neuraminidase__InfluenzaB__AGX20958
augcugcccagcaccauccagacccugacccuguuccugaccagcggcggcgugcugcugagccuguacgugagcgcccugcugagcuaccugcuguacagcgacauccugcugaaguucagccccaccgagaucaccacccccaccaugagccuggacugcaccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagauccaggagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182067 - RNA, 1401 nt, Artificial Sequence; identical to SEQ ID NO: 181639
  derived and/or modified sequence opt4 from neuraminidase__InfluenzaB__AGX20969

SEQ ID NO: 182068 - RNA, 1401 nt, Artificial Sequence; identical to SEQ ID NO: 182052
  derived and/or modified sequence opt4 from neuraminidase__InfluenzaB__AGX20980

SEQ ID NO: 182069 - RNA, 1401 nt, Artificial Sequence
  derived and/or modified sequence opt4 from neuraminidase__InfluenzaB__AGX20991
augcugcccagcaccauccagacccugacccuguuccugaccagcggcggcgugcugcugagccuguacgugagcgcccugcugagcuaccugcuguacagcgacauccugcccaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagaaagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182070 - RNA, 1401 nt, Artificial Sequence; identical to SEQ ID NO: 181476
  derived and/or modified sequence opt4 from neuraminidase__InfluenzaB__AGX21002

SEQ ID NO: 182071 - RNA, 1401 nt, Artificial Sequence
  derived and/or modified sequence opt4 from neuraminidase__InfluenzaB__AGX21013
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182072 - RNA, 1401 nt, Artificial Sequence
  derived and/or modified sequence opt4 from neuraminidase__InfluenzaB__AGX21024
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagccccaacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgaggugagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182073 - RNA, 1401 nt, Artificial Sequence; identical to SEQ ID NO: 181476
  derived and/or modified sequence opt4 from neuraminidase__InfluenzaB__AGX21035

SEQ ID NO: 182074 - RNA, 1401 nt, Artificial Sequence; identical to SEQ ID NO: 181639
  derived and/or modified sequence opt4 from neuraminidase__InfluenzaB__AGX21046

SEQ ID NO: 182075 - RNA, 1401 nt, Artificial Sequence; identical to SEQ ID NO: 181642
  derived and/or modified sequence opt4 from neuraminidase__InfluenzaB__AGX21057

SEQ ID NO: 182076 - RNA, 1401 nt, Artificial Sequence; identical to SEQ ID NO: 182060
  derived and/or modified sequence opt4 from neuraminidase__InfluenzaB__AGX21068

SEQ ID NO: 182077 - RNA, 1401 nt, Artificial Sequence
  derived and/or modified sequence opt4 from neuraminidase__InfluenzaB__AGX21079
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccagcaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182078 - RNA, 1401 nt, Artificial Sequence; identical to SEQ ID NO: 181642
  derived and/or modified sequence opt4 from neuraminidase__InfluenzaB__AGX21088

SEQ ID NO: 182079 - RNA, 1401 nt, Artificial Sequence; identical to SEQ ID NO: 181642
  derived and/or modified sequence opt4 from neuraminidase__InfluenzaB__AGX21099

SEQ ID NO: 182080 - RNA, 1401 nt, Artificial Sequence
  derived and/or modified sequence opt4 from neuraminidase__InfluenzaB__AGX21110
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagauucgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182081 - RNA, 1401 nt, Artificial Sequence
  derived and/or modified sequence opt4 from neuraminidase__InfluenzaB__AGX21121
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaccaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182082 - RNA, 1401 nt, Artificial Sequence; identical to SEQ ID NO: 181639
  derived and/or modified sequence opt4 from neuraminidase__InfluenzaB__AGX21132

SEQ ID NO: 182083 - RNA, 1401 nt, Artificial Sequence; identical to SEQ ID NO: 181415
  derived and/or modified sequence opt4 from neuraminidase__InfluenzaB__AGX21143

SEQ ID NO: 182084 - RNA, 1401 nt, Artificial Sequence; identical to SEQ ID NO: 181476
  derived and/or modified sequence opt4 from neuraminidase__InfluenzaB__AGX21154

SEQ ID NO: 182085 - RNA, 1401 nt, Artificial Sequence
  derived and/or modified sequence opt4 from neuraminidase__InfluenzaB__AGX21165
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacauggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182086 - RNA, 1401 nt, Artificial Sequence; identical to SEQ ID NO: 181476
  derived and/or modified sequence opt4 from neuraminidase__InfluenzaB__AGX21176

SEQ ID NO: 182087 - RNA, 1401 nt, Artificial Sequence
  derived and/or modified sequence opt4 from neuraminidase__InfluenzaB__AGX21187
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgugugcagagacaacagcuacaccgccaagagacccuucgugaagcugaacguggagaccgacaccgccgaggugagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182088 - RNA, 1401 nt, Artificial Sequence
  derived and/or modified sequence opt4 from neuraminidase__InfluenzaB__AGX21198
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcgagcccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182089 - RNA, 1401 nt, Artificial Sequence; identical to SEQ ID NO: 181476
  derived and/or modified sequence opt4 from neuraminidase__InfluenzaB__AGX21209

SEQ ID NO: 182090 - RNA, 1401 nt, Artificial Sequence; identical to SEQ ID NO: 181639
  derived and/or modified sequence opt4 from neuraminidase__InfluenzaB__AGX21220

SEQ ID NO: 182091 - RNA, 1401 nt, Artificial Sequence
  derived and/or modified sequence opt4 from neuraminidase__InfluenzaB__AGX21231
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagagcgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182092 - RNA, 1401 nt, Artificial Sequence; identical to SEQ ID NO: 181642
  derived and/or modified sequence opt4 from neuraminidase__InfluenzaB__AGX21242

SEQ ID NO: 182093 - RNA, 1401 nt, Artificial Sequence; identical to SEQ ID NO: 181476
  derived and/or modified sequence opt4 from neuraminidase__InfluenzaB__AGX21253

SEQ ID NO: 182094 - RNA, 1401 nt, Artificial Sequence
  derived and/or modified sequence opt4 from neuraminidase__InfluenzaB__AGX21264
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaacaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccagcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182095 - RNA, 1401 nt, Artificial Sequence; identical to SEQ ID NO: 181415
  derived and/or modified sequence opt4 from neuraminidase__InfluenzaB__AGX21275

SEQ ID NO: 182096 - RNA, 1401 nt, Artificial Sequence; identical to SEQ ID NO: 181476
  derived and/or modified sequence opt4 from neuraminidase__InfluenzaB__AGX21286

SEQ ID NO: 182097 - RNA, 1401 nt, Artificial Sequence
  derived and/or modified sequence opt4 from neuraminidase__InfluenzaB__AGX21297
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgacuggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgaggugagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182098 - RNA, 1401 nt, Artificial Sequence
  derived and/or modified sequence opt4 from neuraminidase__InfluenzaB__AGX21308
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggcccugagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182099 - RNA, 1401 nt, Artificial Sequence; identical to SEQ ID NO: 181420
  derived and/or modified sequence opt4 from neuraminidase__InfluenzaB__AGX21319

SEQ ID NO: 182100 - RNA, 1401 nt, Artificial Sequence; identical to SEQ ID NO: 181415
  derived and/or modified sequence opt4 from neuraminidase__InfluenzaB__AGX21330

SEQ ID NO: 182101 - RNA, 1401 nt, Artificial Sequence; identical to SEQ ID NO: 181415
  derived and/or modified sequence opt4 from neuraminidase__InfluenzaB__AGX21341

SEQ ID NO: 182102 - RNA, 1401 nt, Artificial Sequence; identical to SEQ ID NO: 181642
  derived and/or modified sequence opt4 from neuraminidase__InfluenzaB__AGX21352

SEQ ID NO: 182103 - RNA, 1401 nt, Artificial Sequence
  derived and/or modified sequence opt4 from neuraminidase__InfluenzaB__AGX21363
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcagccacagauucggcgagaccaagggcaacagcgccccccugaucaucagagagcccuucguggccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182104 - RNA, 1401 nt, Artificial Sequence; identical to SEQ ID NO: 181415
  derived and/or modified sequence opt4 from neuraminidase__InfluenzaB__AGX21374

SEQ ID NO: 182105 - RNA, 1401 nt, Artificial Sequence; identical to SEQ ID NO: 181476
  derived and/or modified sequence opt4 from neuraminidase__InfluenzaB__AGX21385

SEQ ID NO: 182106 - RNA, 1401 nt, Artificial Sequence; identical to SEQ ID NO: 181476
  derived and/or modified sequence opt4 from neuraminidase__InfluenzaB__AGX21396

SEQ ID NO: 182107 - RNA, 1401 nt, Artificial Sequence; identical to SEQ ID NO: 181415
  derived and/or modified sequence opt4 from neuraminidase__InfluenzaB__AGX21407

SEQ ID NO: 182108 - RNA, 1401 nt, Artificial Sequence; identical to SEQ ID NO: 181415
  derived and/or modified sequence opt4 from neuraminidase__InfluenzaB__AGX21418

SEQ ID NO: 182109 - RNA, 1401 nt, Artificial Sequence
  derived and/or modified sequence opt4 from neuraminidase__InfluenzaB__AGX21429
augcugcccagcaccauccagacccugacccuguuccugaccagcggcggcgugcugcugagccuguacgugagcgcccugcugagcuaccugcugcacagcgacauccugcugaaguucagccccaccgagaucaccgcccccaccaugagccuggacugcgccaacgccagcaacgugcaggccgugaacagaagcgugaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182110 - RNA, 1401 nt, Artificial Sequence; identical to SEQ ID NO: 181476
  derived and/or modified sequence opt4 from neuraminidase__InfluenzaB__AGX21440

SEQ ID NO: 182111 - RNA, 1401 nt, Artificial Sequence; identical to SEQ ID NO: 181476
  derived and/or modified sequence opt4 from neuraminidase__InfluenzaB__AGX21451

SEQ ID NO: 182112 - RNA, 1401 nt, Artificial Sequence; identical to SEQ ID NO: 182060
  derived and/or modified sequence opt4 from neuraminidase__InfluenzaB__AGX21462

SEQ ID NO: 182113 - RNA, 1401 nt, Artificial Sequence
  derived and/or modified sequence opt4 from neuraminidase__InfluenzaB__AGX21473
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagagagcccugcugaucagcccccacagauucggcgaggccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagauccugcccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182114 - RNA, 1401 nt, Artificial Sequence; identical to SEQ ID NO: 181420
  derived and/or modified sequence opt4 from neuraminidase__InfluenzaB__AGX21484

SEQ ID NO: 182115 - RNA, 1401 nt, Artificial Sequence; identical to SEQ ID NO: 181476
  derived and/or modified sequence opt4 from neuraminidase__InfluenzaB__AGX21495

SEQ ID NO: 182116 - RNA, 1401 nt, Artificial Sequence; identical to SEQ ID NO: 181476
  derived and/or modified sequence opt4 from neuraminidase__InfluenzaB__AGX21506

SEQ ID NO: 182117 - RNA, 1401 nt, Artificial Sequence
  derived and/or modified sequence opt4 from neuraminidase__InfluenzaB__AGX21517
augcugcccagcaccauccagacccugacccuguuccugaccagcggcggcgugcugcugagccuguacgugagcgcccugcugagcuaccugcuguacagcaacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182118 - RNA, 1401 nt, Artificial Sequence
  derived and/or modified sequence opt4 from neuraminidase__InfluenzaB__AGX21528
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgaggugagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacagcggcaaggagaccuggcacagcgccgccaccgccaucuacugccugaugggcagcggccagcugcugugggacaccgugaccggcguggacauggcccuguga

SEQ ID NO: 182119 - RNA, 1401 nt, Artificial Sequence; identical to SEQ ID NO: 181476
  derived and/or modified sequence opt4 from neuraminidase__InfluenzaB__AGX21539

SEQ ID NO: 182120 - RNA, 1401 nt, Artificial Sequence
  derived and/or modified sequence opt4 from neuraminidase__InfluenzaB__AGX21550
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccgccggcagagugaagcacaccgaggagugcaccugcggcuucgccagcaacaagaccaucgagugcgccugcagagacaacagcuacaccgccaagagacccuucgugaagcugaacguggagaccgacaccgccgaggugagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182121 - RNA, 1401 nt, Artificial Sequence
  derived and/or modified sequence opt4 from neuraminidase__InfluenzaB__AGX21561
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaaggugagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgaggugagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182122 - RNA, 1401 nt, Artificial Sequence; identical to SEQ ID NO: 181420
  derived and/or modified sequence opt4 from neuraminidase__InfluenzaB__AGX21572

SEQ ID NO: 182123 - RNA, 1401 nt, Artificial Sequence
  derived and/or modified sequence opt4 from neuraminidase__InfluenzaB__AGX21583
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagagagcccugcugaucagcccccacagauucggcgaggccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagauccugcccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcauggagcuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182124 - RNA, 1401 nt, Artificial Sequence; identical to SEQ ID NO: 181420
  derived and/or modified sequence opt4 from neuraminidase__InfluenzaB__AGX21594

SEQ ID NO: 182125 - RNA, 1401 nt, Artificial Sequence; identical to SEQ ID NO: 181642
  derived and/or modified sequence opt4 from neuraminidase__InfluenzaB__AGX21605

SEQ ID NO: 182126 - RNA, 1401 nt, Artificial Sequence
  derived and/or modified sequence opt4 from neuraminidase__InfluenzaB__AGX21615
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaacaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182127 - RNA, 1401 nt, Artificial Sequence; identical to SEQ ID NO: 181476
  derived and/or modified sequence opt4 from neuraminidase__InfluenzaB__AGX21626

SEQ ID NO: 182128 - RNA, 1401 nt, Artificial Sequence; identical to SEQ ID NO: 181476
  derived and/or modified sequence opt4 from neuraminidase__InfluenzaB__AGX21637

SEQ ID NO: 182129 - RNA, 1401 nt, Artificial Sequence; identical to SEQ ID NO: 181476
  derived and/or modified sequence opt4 from neuraminidase__InfluenzaB__AGX21648

SEQ ID NO: 182130 - RNA, 1401 nt, Artificial Sequence
  derived and/or modified sequence opt4 from neuraminidase__InfluenzaB__AGX21659
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccuggugagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacggcggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182131 - RNA, 1401 nt, Artificial Sequence
  derived and/or modified sequence opt4 from neuraminidase__InfluenzaB__AGX21670
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaccgagauggugcacgacggcggcaaggagaccuggcacagcgccgccaccgccaucuacugccugaugggcagcggccagcugcugugggacaccgugaccggcguggacauggcccuguga

SEQ ID NO: 182132 - RNA, 1401 nt, Artificial Sequence
  derived and/or modified sequence opt4 from neuraminidase__InfluenzaB__AGX21681
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcaacggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182133 - RNA, 1401 nt, Artificial Sequence; identical to SEQ ID NO: 181415
  derived and/or modified sequence opt4 from neuraminidase__InfluenzaB__AGX21692

SEQ ID NO: 182134 - RNA, 1401 nt, Artificial Sequence; identical to SEQ ID NO: 181642
  derived and/or modified sequence opt4 from neuraminidase__InfluenzaB__AGX21703

SEQ ID NO: 182135 - RNA, 1401 nt, Artificial Sequence
  derived and/or modified sequence opt4 from neuraminidase__InfluenzaB__AGX21714
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggccugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182136 - RNA, 1401 nt, Artificial Sequence
  derived and/or modified sequence opt4 from neuraminidase__InfluenzaB__AGX21725
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagagagcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182137 - RNA, 1401 nt, Artificial Sequence
  derived and/or modified sequence opt4 from neuraminidase__InfluenzaB__AGX21747
augcugcccagcaccauccagacccugacccuguuccugaccagcggcggcgugcugcugagccuguacgugagcgccagccugagcuaccugcuguacagcgacauccugcugaaggugagccagaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182138 - RNA, 1401 nt, Artificial Sequence
  derived and/or modified sequence opt4 from neuraminidase__InfluenzaB__AGX21758
augcugcccagcaccauccagacccugacccuguuccugaccagcggcggcgugcugcugagccuguacgugagcgccagccugagcuaccugcuguacagcgacauccugcugaaguucacccccaccgagaucaccgugcccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182139 - RNA, 1401 nt, Artificial Sequence
  derived and/or modified sequence opt4 from neuraminidase__InfluenzaB__AGX21769
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgccaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182140 - RNA, 1401 nt, Artificial Sequence
  derived and/or modified sequence opt4 from neuraminidase__InfluenzaB__AGX21780
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacaugacccuguga

SEQ ID NO: 182141 - RNA, 1401 nt, Artificial Sequence
  derived and/or modified sequence opt4 from neuraminidase__InfluenzaB__AGX21791
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacagcggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacaacuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaacaagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182142 - RNA, 1401 nt, Artificial Sequence
  derived and/or modified sequence opt4 from neuraminidase__InfluenzaB__AGX21802
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgccaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182143 - RNA, 1401 nt, Artificial Sequence
  derived and/or modified sequence opt4 from neuraminidase__InfluenzaB__AGX21813
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaagaugccccuggacugcgccaacgccagcaacgugcaggccgccaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182144 - RNA, 1401 nt, Artificial Sequence
  derived and/or modified sequence opt4 from neuraminidase__InfluenzaB__AGX21824
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagaacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182145 - RNA, 1401 nt, Artificial Sequence; identical to SEQ ID NO: 181263
  derived and/or modified sequence opt4 from neuraminidase__InfluenzaB__AGX21835

SEQ ID NO: 182146 - RNA, 1401 nt, Artificial Sequence; identical to SEQ ID NO: 181651
  derived and/or modified sequence opt4 from neuraminidase__InfluenzaB__AGX21846

SEQ ID NO: 182147 - RNA, 1401 nt, Artificial Sequence; identical to SEQ ID NO: 181651
  derived and/or modified sequence opt4 from neuraminidase__InfluenzaB__AGX21857

SEQ ID NO: 182148 - RNA, 1401 nt, Artificial Sequence; identical to SEQ ID NO: 181263
  derived and/or modified sequence opt4 from neuraminidase__InfluenzaB__AGX21868

SEQ ID NO: 182149 - RNA, 1401 nt, Artificial Sequence; identical to SEQ ID NO: 181649
  derived and/or modified sequence opt4 from neuraminidase__InfluenzaB__AGX21879

SEQ ID NO: 182150 - RNA, 1401 nt, Artificial Sequence
  derived and/or modified sequence opt4 from neuraminidase__InfluenzaB__AGX21890
augcugcccagcaccauccagacccugacccuguuccugaccagcggcggcgugcugcugagccuguacgugagcgccagccugagcuaccugcuguacagcgacauccugcugaaguucagccagaccgagaucaucgcccccaucaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182151 - RNA, 1401 nt, Artificial Sequence; identical to SEQ ID NO: 181263
  derived and/or modified sequence opt4 from neuraminidase__InfluenzaB__AGX21901

SEQ ID NO: 182152 - RNA, 1401 nt, Artificial Sequence; identical to SEQ ID NO: 181263
  derived and/or modified sequence opt4 from neuraminidase__InfluenzaB__AGX21912

SEQ ID NO: 182153 - RNA, 1401 nt, Artificial Sequence
  derived and/or modified sequence opt4 from neuraminidase__InfluenzaB__AGX21923
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcaccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182154 - RNA, 1401 nt, Artificial Sequence; identical to SEQ ID NO: 182150
  derived and/or modified sequence opt4 from neuraminidase__InfluenzaB__AGX21934

SEQ ID NO: 182155 - RNA, 1401 nt, Artificial Sequence; identical to SEQ ID NO: 181651
  derived and/or modified sequence opt4 from neuraminidase__InfluenzaB__AGX21945

SEQ ID NO: 182156 - RNA, 1401 nt, Artificial Sequence
  derived and/or modified sequence opt4 from neuraminidase__InfluenzaB__AGX21956
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacaccagcaacauccaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182157 - RNA, 1401 nt, Artificial Sequence; identical to SEQ ID NO: 181651
  derived and/or modified sequence opt4 from neuraminidase__InfluenzaB__AGX21967

SEQ ID NO: 182158 - RNA, 1401 nt, Artificial Sequence; identical to SEQ ID NO: 181263
  derived and/or modified sequence opt4 from neuraminidase__InfluenzaB__AGX21978

SEQ ID NO: 182159 - RNA, 1401 nt, Artificial Sequence; identical to SEQ ID NO: 181651
  derived and/or modified sequence opt4 from neuraminidase__InfluenzaB__AGX21989

SEQ ID NO: 182160 - RNA, 1401 nt, Artificial Sequence; identical to SEQ ID NO: 181649
  derived and/or modified sequence opt4 from neuraminidase__InfluenzaB__AGX22000

SEQ ID NO: 182161 - RNA, 1401 nt, Artificial Sequence
  derived and/or modified sequence opt4 from neuraminidase__InfluenzaB__AGX22011
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgccaagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacaacuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182162 - RNA, 1401 nt, Artificial Sequence; identical to SEQ ID NO: 181263
  derived and/or modified sequence opt4 from neuraminidase__InfluenzaB__AGX22033

SEQ ID NO: 182163 - RNA, 1401 nt, Artificial Sequence; identical to SEQ ID NO: 181263
  derived and/or modified sequence opt4 from neuraminidase__InfluenzaB__AGX22044

SEQ ID NO: 182164 - RNA, 1401 nt, Artificial Sequence; identical to SEQ ID NO: 181649
  derived and/or modified sequence opt4 from neuraminidase__InfluenzaB__AGX22055

SEQ ID NO: 182165 - RNA, 1401 nt, Artificial Sequence; identical to SEQ ID NO: 181263
  derived and/or modified sequence opt4 from neuraminidase__InfluenzaB__AGX22066

SEQ ID NO: 182166 - RNA, 1401 nt, Artificial Sequence; identical to SEQ ID NO: 182150
  derived and/or modified sequence opt4 from neuraminidase__InfluenzaB__AGX22077

SEQ ID NO: 182167 - RNA, 1401 nt, Artificial Sequence; identical to SEQ ID NO: 181265
  derived and/or modified sequence opt4 from neuraminidase__InfluenzaB__AGX22088

SEQ ID NO: 182168 - RNA, 1401 nt, Artificial Sequence; identical to SEQ ID NO: 181651
  derived and/or modified sequence opt4 from neuraminidase__InfluenzaB__AGX22099

SEQ ID NO: 182169 - RNA, 1401 nt, Artificial Sequence; identical to SEQ ID NO: 181649
  derived and/or modified sequence opt4 from neuraminidase__InfluenzaB__AGX22110

SEQ ID NO: 182170 - RNA, 1401 nt, Artificial Sequence; identical to SEQ ID NO: 181651
  derived and/or modified sequence opt4 from neuraminidase__InfluenzaB__AGX22132

SEQ ID NO: 182171 - RNA, 1401 nt, Artificial Sequence
  derived and/or modified sequence opt4 from neuraminidase__InfluenzaB__AGX22143
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaucagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182172 - RNA, 1401 nt, Artificial Sequence; identical to SEQ ID NO: 182171
  derived and/or modified sequence opt4 from neuraminidase__InfluenzaB__AGX22154

SEQ ID NO: 182173 - RNA, 1401 nt, Artificial Sequence; identical to SEQ ID NO: 182171
  derived and/or modified sequence opt4 from neuraminidase__InfluenzaB__AGX22165

SEQ ID NO: 182174 - RNA, 1401 nt, Artificial Sequence; identical to SEQ ID NO: 182150
  derived and/or modified sequence opt4 from neuraminidase__InfluenzaB__AGX22176

SEQ ID NO: 182175 - RNA, 1401 nt, Artificial Sequence; identical to SEQ ID NO: 182171
  derived and/or modified sequence opt4 from neuraminidase__InfluenzaB__AGX22187

SEQ ID NO: 182176 - RNA, 1401 nt, Artificial Sequence; identical to SEQ ID NO: 182171
  derived and/or modified sequence opt4 from neuraminidase__InfluenzaB__AGX22198

SEQ ID NO: 182177 - RNA, 1401 nt, Artificial Sequence; identical to SEQ ID NO: 182171
  derived and/or modified sequence opt4 from neuraminidase__InfluenzaB__AGX22209

SEQ ID NO: 182178 - RNA, 1401 nt, Artificial Sequence; identical to SEQ ID NO: 181649
  derived and/or modified sequence opt4 from neuraminidase__InfluenzaB__AGX22220

SEQ ID NO: 182179 - RNA, 1401 nt, Artificial Sequence; identical to SEQ ID NO: 181651
  derived and/or modified sequence opt4 from neuraminidase__InfluenzaB__AGX22231

SEQ ID NO: 182180 - RNA, 1401 nt, Artificial Sequence; identical to SEQ ID NO: 182150
  derived and/or modified sequence opt4 from neuraminidase__InfluenzaB__AGX22242

SEQ ID NO: 182181 - RNA, 1401 nt, Artificial Sequence; identical to SEQ ID NO: 181649
  derived and/or modified sequence opt4 from neuraminidase__InfluenzaB__AGX22253

SEQ ID NO: 182182 - RNA, 1401 nt, Artificial Sequence; identical to SEQ ID NO: 181263
  derived and/or modified sequence opt4 from neuraminidase__InfluenzaB__AGX22264

SEQ ID NO: 182183 - RNA, 1401 nt, Artificial Sequence; identical to SEQ ID NO: 181649
  derived and/or modified sequence opt4 from neuraminidase__InfluenzaB__AGX22275

SEQ ID NO: 182184 - RNA, 1401 nt, Artificial Sequence; identical to SEQ ID NO: 181263
  derived and/or modified sequence opt4 from neuraminidase__InfluenzaB__AGX22286

SEQ ID NO: 182185 - RNA, 1401 nt, Artificial Sequence
  derived and/or modified sequence opt4 from neuraminidase__InfluenzaB__AGX22297
augcugcccagcaccauccagacccugacccuguuccugacccugggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182186 - RNA, 1401 nt, Artificial Sequence; identical to SEQ ID NO: 181263
  derived and/or modified sequence opt4 from neuraminidase__InfluenzaB__AGX22308

SEQ ID NO: 182187 - RNA, 1401 nt, Artificial Sequence
  derived and/or modified sequence opt4 from neuraminidase__InfluenzaB__AGX22330
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacaugaccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccaccaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182188 - RNA, 1401 nt, Artificial Sequence; identical to SEQ ID NO: 181651
  derived and/or modified sequence opt4 from neuraminidase__InfluenzaB__AGX22341

SEQ ID NO: 182189 - RNA, 1401 nt, Artificial Sequence; identical to SEQ ID NO: 181651
  derived and/or modified sequence opt4 from neuraminidase__InfluenzaB__AGX22352

SEQ ID NO: 182190 - RNA, 1401 nt, Artificial Sequence; identical to SEQ ID NO: 181651
  derived and/or modified sequence opt4 from neuraminidase__InfluenzaB__AGX22363

SEQ ID NO: 182191 - RNA, 1401 nt, Artificial Sequence; identical to SEQ ID NO: 181649
  derived and/or modified sequence opt4 from neuraminidase__InfluenzaB__AGX22374

SEQ ID NO: 182192 - RNA, 1401 nt, Artificial Sequence; identical to SEQ ID NO: 181263
  derived and/or modified sequence opt4 from neuraminidase__InfluenzaB__AGX22385

SEQ ID NO: 182193 - RNA, 1401 nt, Artificial Sequence; identical to SEQ ID NO: 181263
  derived and/or modified sequence opt4 from neuraminidase__InfluenzaB__AGX22396

SEQ ID NO: 182194 - RNA, 1401 nt, Artificial Sequence; identical to SEQ ID NO: 182150
  derived and/or modified sequence opt4 from neuraminidase__InfluenzaB__AGX22407

SEQ ID NO: 182195 - RNA, 1401 nt, Artificial Sequence
  derived and/or modified sequence opt4 from neuraminidase__InfluenzaB__AGX22418
augcugcccagcaccauccagacccugacccuguuccugaccagcggcggcgugcugcugagccuguacgugagcgccagccugagcuaccugcuguacagcgacauccugcugaaguucagccagaccgagaucaucgcccccaucaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcagauacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182196 - RNA, 1401 nt, Artificial Sequence; identical to SEQ ID NO: 181649
  derived and/or modified sequence opt4 from neuraminidase__InfluenzaB__AGX22429

SEQ ID NO: 182197 - RNA, 1401 nt, Artificial Sequence; identical to SEQ ID NO: 181649
  derived and/or modified sequence opt4 from neuraminidase__InfluenzaB__AGX22440

SEQ ID NO: 182198 - RNA, 1401 nt, Artificial Sequence; identical to SEQ ID NO: 181649
  derived and/or modified sequence opt4 from neuraminidase__InfluenzaB__AGX22449

SEQ ID NO: 182199 - RNA, 1401 nt, Artificial Sequence
  derived and/or modified sequence opt4 from neuraminidase__InfluenzaB__AGX22460
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccaccaagggcgugacccugcugcugcccgagcuggaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcuggacguggagaccgacaccgccgagaucagacugaugugcaccgagaccuaccuggacacccccagacccaacgacggcagcaucaccggccccugcgaggccaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182200 - RNA, 1401 nt, Artificial Sequence; identical to SEQ ID NO: 181263
  derived and/or modified sequence opt4 from neuraminidase__InfluenzaB__AGX22471

SEQ ID NO: 182201 - RNA, 1401 nt, Artificial Sequence; identical to SEQ ID NO: 181263
  derived and/or modified sequence opt4 from neuraminidase__InfluenzaB__AGX22482

SEQ ID NO: 182202 - RNA, 1401 nt, Artificial Sequence; identical to SEQ ID NO: 181263
  derived and/or modified sequence opt4 from neuraminidase__InfluenzaB__AGX22493

SEQ ID NO: 182203 - RNA, 1401 nt, Artificial Sequence
  derived and/or modified sequence opt4 from neuraminidase__InfluenzaB__AGX22504
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaucccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182204 - RNA, 1401 nt, Artificial Sequence; identical to SEQ ID NO: 181649
  derived and/or modified sequence opt4 from neuraminidase__InfluenzaB__AGX22515

SEQ ID NO: 182205 - RNA, 1401 nt, Artificial Sequence
  derived and/or modified sequence opt4 from neuraminidase__InfluenzaB__AGX22526
augcugcccagcaccauccagacccugacccuguuccugaccagcggcggcgugcugcugagccuguacgugagcgccagccugagcuaccugcuguacagcgacauccugcagaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182206 - RNA, 1401 nt, Artificial Sequence; identical to SEQ ID NO: 181308
  derived and/or modified sequence opt4 from neuraminidase__InfluenzaB__AGX22548

SEQ ID NO: 182207 - RNA, 1401 nt, Artificial Sequence; identical to SEQ ID NO: 181147
  derived and/or modified sequence opt4 from neuraminidase__InfluenzaB__AGX22559

SEQ ID NO: 182208 - RNA, 1401 nt, Artificial Sequence; identical to SEQ ID NO: 181308
  derived and/or modified sequence opt4 from neuraminidase__InfluenzaB__AGX22570

SEQ ID NO: 182209 - RNA, 1401 nt, Artificial Sequence
  derived and/or modified sequence opt4 from neuraminidase__InfluenzaB__AGX22581
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacaacaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacaacuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182210 - RNA, 1401 nt, Artificial Sequence; identical to SEQ ID NO: 181308
  derived and/or modified sequence opt4 from neuraminidase__InfluenzaB__AGX22592

SEQ ID NO: 182211 - RNA, 1401 nt, Artificial Sequence; identical to SEQ ID NO: 181308
  derived and/or modified sequence opt4 from neuraminidase__InfluenzaB__AGX22603

SEQ ID NO: 182212 - RNA, 1401 nt, Artificial Sequence; identical to SEQ ID NO: 181548
  derived and/or modified sequence opt4 from neuraminidase__InfluenzaB__AGX22614

SEQ ID NO: 182213 - RNA, 1401 nt, Artificial Sequence; identical to SEQ ID NO: 181308
  derived and/or modified sequence opt4 from neuraminidase__InfluenzaB__AGX22625

SEQ ID NO: 182214 - RNA, 1401 nt, Artificial Sequence
  derived and/or modified sequence opt4 from neuraminidase__InfluenzaB__AGX22636
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcguggcccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182215 - RNA, 1401 nt, Artificial Sequence; identical to SEQ ID NO: 181308
  derived and/or modified sequence opt4 from neuraminidase__InfluenzaB__AGX22647

SEQ ID NO: 182216 - RNA, 1401 nt, Artificial Sequence; identical to SEQ ID NO: 181147
  derived and/or modified sequence opt4 from neuraminidase__InfluenzaB__AGX22658

SEQ ID NO: 182217 - RNA, 1401 nt, Artificial Sequence; identical to SEQ ID NO: 181308
  derived and/or modified sequence opt4 from neuraminidase__InfluenzaB__AGX22669

SEQ ID NO: 182218 - RNA, 1401 nt, Artificial Sequence; identical to SEQ ID NO: 181308
  derived and/or modified sequence opt4 from neuraminidase__InfluenzaB__AGX22680

SEQ ID NO: 182219 - RNA, 1401 nt, Artificial Sequence; identical to SEQ ID NO: 181308
  derived and/or modified sequence opt4 from neuraminidase__InfluenzaB__AGX22691

SEQ ID NO: 182220 - RNA, 1401 nt, Artificial Sequence; identical to SEQ ID NO: 181308
  derived and/or modified sequence opt4 from neuraminidase__InfluenzaB__AGX22702

SEQ ID NO: 182221 - RNA, 1401 nt, Artificial Sequence; identical to SEQ ID NO: 181308
  derived and/or modified sequence opt4 from neuraminidase__InfluenzaB__AGX22713

SEQ ID NO: 182222 - RNA, 1401 nt, Artificial Sequence
  derived and/or modified sequence opt4 from neuraminidase__InfluenzaB__AGX22724
augcugcccagcaccauccagacccugacccuguuccugaccagcggcggcgugcugcugagccuguacgugagcgcccugcugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182223 - RNA, 1401 nt, Artificial Sequence; identical to SEQ ID NO: 181308
  derived and/or modified sequence opt4 from neuraminidase__InfluenzaB__AGX22735

SEQ ID NO: 182224 - RNA, 1401 nt, Artificial Sequence
  derived and/or modified sequence opt4 from neuraminidase__InfluenzaB__AGX22746
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacagaaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182225 - RNA, 1401 nt, Artificial Sequence; identical to SEQ ID NO: 181308
  derived and/or modified sequence opt4 from neuraminidase__InfluenzaB__AGX22757

SEQ ID NO: 182226 - RNA, 1401 nt, Artificial Sequence; identical to SEQ ID NO: 181308
  derived and/or modified sequence opt4 from neuraminidase__InfluenzaB__AGX22768

SEQ ID NO: 182227 - RNA, 1401 nt, Artificial Sequence; identical to SEQ ID NO: 181649
  derived and/or modified sequence opt4 from neuraminidase__InfluenzaB__AGX22779

SEQ ID NO: 182228 - RNA, 1401 nt, Artificial Sequence; identical to SEQ ID NO: 181308
  derived and/or modified sequence opt4 from neuraminidase__InfluenzaB__AGX22790

SEQ ID NO: 182229 - RNA, 1401 nt, Artificial Sequence
  derived and/or modified sequence opt4 from neuraminidase__InfluenzaB__AGX22801
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182230 - RNA, 1401 nt, Artificial Sequence; identical to SEQ ID NO: 181308
  derived and/or modified sequence opt4 from neuraminidase__InfluenzaB__AGX22812

SEQ ID NO: 182231 - RNA, 1401 nt, Artificial Sequence; identical to SEQ ID NO: 181308
  derived and/or modified sequence opt4 from neuraminidase__InfluenzaB__AGX22823

SEQ ID NO: 182232 - RNA, 1401 nt, Artificial Sequence; identical to SEQ ID NO: 181308
  derived and/or modified sequence opt4 from neuraminidase__InfluenzaB__AGX22834

SEQ ID NO: 182233 - RNA, 1401 nt, Artificial Sequence; identical to SEQ ID NO: 181308
  derived and/or modified sequence opt4 from neuraminidase__InfluenzaB__AGX22845

SEQ ID NO: 182234 - RNA, 1401 nt, Artificial Sequence; identical to SEQ ID NO: 181308
  derived and/or modified sequence opt4 from neuraminidase__InfluenzaB__AGX22856

SEQ ID NO: 182235 - RNA, 1401 nt, Artificial Sequence; identical to SEQ ID NO: 181308
  derived and/or modified sequence opt4 from neuraminidase__InfluenzaB__AGX22867

SEQ ID NO: 182236 - RNA, 1401 nt, Artificial Sequence; identical to SEQ ID NO: 181308
  derived and/or modified sequence opt4 from neuraminidase__InfluenzaB__AGX22878

SEQ ID NO: 182237 - RNA, 1401 nt, Artificial Sequence
  derived and/or modified sequence opt4 from neuraminidase__InfluenzaB__AGX22889
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagccacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182238 - RNA, 1401 nt, Artificial Sequence; identical to SEQ ID NO: 181147
  derived and/or modified sequence opt4 from neuraminidase__InfluenzaB__AGX22900

SEQ ID NO: 182239 - RNA, 1401 nt, Artificial Sequence
  derived and/or modified sequence opt4 from neuraminidase__InfluenzaB__AGX22911
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaccagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182240 - RNA, 1401 nt, Artificial Sequence
  derived and/or modified sequence opt4 from neuraminidase__InfluenzaB__AGX22922
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacaacgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182241 - RNA, 1401 nt, Artificial Sequence; identical to SEQ ID NO: 181308
  derived and/or modified sequence opt4 from neuraminidase__InfluenzaB__AGX22933

SEQ ID NO: 182242 - RNA, 1401 nt, Artificial Sequence; identical to SEQ ID NO: 181308
  derived and/or modified sequence opt4 from neuraminidase__InfluenzaB__AGX22944

SEQ ID NO: 182243 - RNA, 1401 nt, Artificial Sequence; identical to SEQ ID NO: 181308
  derived and/or modified sequence opt4 from neuraminidase__InfluenzaB__AGX22955

SEQ ID NO: 182244 - RNA, 1401 nt, Artificial Sequence; identical to SEQ ID NO: 181308
  derived and/or modified sequence opt4 from neuraminidase__InfluenzaB__AGX22966

SEQ ID NO: 182245 - RNA, 1401 nt, Artificial Sequence; identical to SEQ ID NO: 181147
  derived and/or modified sequence opt4 from neuraminidase__InfluenzaB__AGX22977

SEQ ID NO: 182246 - RNA, 1401 nt, Artificial Sequence; identical to SEQ ID NO: 181563
  derived and/or modified sequence opt4 from neuraminidase__InfluenzaB__AGX22988

SEQ ID NO: 182247 - RNA, 1401 nt, Artificial Sequence
  derived and/or modified sequence opt4 from neuraminidase__InfluenzaB__AGX22999
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgagugggccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182248 - RNA, 1401 nt, Artificial Sequence; identical to SEQ ID NO: 182247
  derived and/or modified sequence opt4 from neuraminidase__InfluenzaB__AGX23010

SEQ ID NO: 182249 - RNA, 1401 nt, Artificial Sequence; identical to SEQ ID NO: 181147
  derived and/or modified sequence opt4 from neuraminidase__InfluenzaB__AGX23021

SEQ ID NO: 182250 - RNA, 1401 nt, Artificial Sequence; identical to SEQ ID NO: 181308
  derived and/or modified sequence opt4 from neuraminidase__InfluenzaB__AGX23032

SEQ ID NO: 182251 - RNA, 1401 nt, Artificial Sequence
  derived and/or modified sequence opt4 from neuraminidase__InfluenzaB__AGX23043
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgcccugggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182252 - RNA, 1401 nt, Artificial Sequence; identical to SEQ ID NO: 181147
  derived and/or modified sequence opt4 from neuraminidase__InfluenzaB__AGX23054

SEQ ID NO: 182253 - RNA, 1401 nt, Artificial Sequence; identical to SEQ ID NO: 181147
  derived and/or modified sequence opt4 from neuraminidase__InfluenzaB__AGX23065

SEQ ID NO: 182254 - RNA, 1401 nt, Artificial Sequence; identical to SEQ ID NO: 181147
  derived and/or modified sequence opt4 from neuraminidase__InfluenzaB__AGX23076

SEQ ID NO: 182255 - RNA, 1401 nt, Artificial Sequence; identical to SEQ ID NO: 181308
  derived and/or modified sequence opt4 from neuraminidase__InfluenzaB__AGX23087

SEQ ID NO: 182256 - RNA, 1401 nt, Artificial Sequence; identical to SEQ ID NO: 181147
  derived and/or modified sequence opt4 from neuraminidase__InfluenzaB__AGX23098

SEQ ID NO: 182257 - RNA, 1401 nt, Artificial Sequence
  derived and/or modified sequence opt4 from neuraminidase__InfluenzaB__AGX23109
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucagaggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182258 - RNA, 1401 nt, Artificial Sequence; identical to SEQ ID NO: 181308
  derived and/or modified sequence opt4 from neuraminidase__InfluenzaB__AGX23120

SEQ ID NO: 182259 - RNA, 1401 nt, Artificial Sequence
  derived and/or modified sequence opt4 from neuraminidase__InfluenzaB__AGX23131
augcugcccagcaccauccagacccugacccuguuccugaccagcggcggcgugcugcugagccuguacgugagcgccagccugagcuaccugcuguacagcgacauccugcugaaguucagccagaccgagaucaucgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182260 - RNA, 1401 nt, Artificial Sequence; identical to SEQ ID NO: 181308
  derived and/or modified sequence opt4 from neuraminidase__InfluenzaB__AGX23142

SEQ ID NO: 182261 - RNA, 1401 nt, Artificial Sequence; identical to SEQ ID NO: 181147
  derived and/or modified sequence opt4 from neuraminidase__InfluenzaB__AGX23153

SEQ ID NO: 182262 - RNA, 1401 nt, Artificial Sequence; identical to SEQ ID NO: 181147
  derived and/or modified sequence opt4 from neuraminidase__InfluenzaB__AGX23164

SEQ ID NO: 182263 - RNA, 1401 nt, Artificial Sequence; identical to SEQ ID NO: 181147
  derived and/or modified sequence opt4 from neuraminidase__InfluenzaB__AGX23175

SEQ ID NO: 182264 - RNA, 1401 nt, Artificial Sequence
  derived and/or modified sequence opt4 from neuraminidase__InfluenzaB__AGX23186
augcugcccagcaccacccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182265 - RNA, 1401 nt, Artificial Sequence; identical to SEQ ID NO: 181308
  derived and/or modified sequence opt4 from neuraminidase__InfluenzaB__AGX23197

SEQ ID NO: 182266 - RNA, 1401 nt, Artificial Sequence; identical to SEQ ID NO: 181308
  derived and/or modified sequence opt4 from neuraminidase__InfluenzaB__AGX23208

SEQ ID NO: 182267 - RNA, 1401 nt, Artificial Sequence; identical to SEQ ID NO: 181308
  derived and/or modified sequence opt4 from neuraminidase__InfluenzaB__AGX23219

SEQ ID NO: 182268 - RNA, 1401 nt, Artificial Sequence
  derived and/or modified sequence opt4 from neuraminidase__InfluenzaB__AGX23230
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcgaguacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccagcagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182269 - RNA, 1401 nt, Artificial Sequence; identical to SEQ ID NO: 181147
  derived and/or modified sequence opt4 from neuraminidase__InfluenzaB__AGX23241

SEQ ID NO: 182270 - RNA, 1401 nt, Artificial Sequence; identical to SEQ ID NO: 181308
  derived and/or modified sequence opt4 from neuraminidase__InfluenzaB__AGX23252

SEQ ID NO: 182271 - RNA, 1401 nt, Artificial Sequence; identical to SEQ ID NO: 181308
  derived and/or modified sequence opt4 from neuraminidase__InfluenzaB__AGX23263

SEQ ID NO: 182272 - RNA, 1401 nt, Artificial Sequence; identical to SEQ ID NO: 181308
  derived and/or modified sequence opt4 from neuraminidase__InfluenzaB__AGX23274

SEQ ID NO: 182273 - RNA, 1401 nt, Artificial Sequence; identical to SEQ ID NO: 181147
  derived and/or modified sequence opt4 from neuraminidase__InfluenzaB__AGX23285

SEQ ID NO: 182274 - RNA, 1401 nt, Artificial Sequence; identical to SEQ ID NO: 181308
  derived and/or modified sequence opt4 from neuraminidase__InfluenzaB__AGX23296

SEQ ID NO: 182275 - RNA, 1401 nt, Artificial Sequence
  derived and/or modified sequence opt4 from neuraminidase__InfluenzaB__AGX23307
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182276 - RNA, 1401 nt, Artificial Sequence; identical to SEQ ID NO: 182275
  derived and/or modified sequence opt4 from neuraminidase__InfluenzaB__AGX23318

SEQ ID NO: 182277 - RNA, 1401 nt, Artificial Sequence; identical to SEQ ID NO: 182275
  derived and/or modified sequence opt4 from neuraminidase__InfluenzaB__AGX23329

SEQ ID NO: 182278 - RNA, 1401 nt, Artificial Sequence; identical to SEQ ID NO: 182275
  derived and/or modified sequence opt4 from neuraminidase__InfluenzaB__AGX23340

SEQ ID NO: 182279 - RNA, 1401 nt, Artificial Sequence; identical to SEQ ID NO: 182275
  derived and/or modified sequence opt4 from neuraminidase__InfluenzaB__AGX23351

SEQ ID NO: 182280 - RNA, 1401 nt, Artificial Sequence; identical to SEQ ID NO: 182275
  derived and/or modified sequence opt4 from neuraminidase__InfluenzaB__AGX23362

SEQ ID NO: 182281 - RNA, 1401 nt, Artificial Sequence; identical to SEQ ID NO: 182275
  derived and/or modified sequence opt4 from neuraminidase__InfluenzaB__AGX23373

SEQ ID NO: 182282 - RNA, 1401 nt, Artificial Sequence; identical to SEQ ID NO: 182275
  derived and/or modified sequence opt4 from neuraminidase__InfluenzaB__AGX23384

SEQ ID NO: 182283 - RNA, 1401 nt, Artificial Sequence
  derived and/or modified sequence opt4 from neuraminidase__InfluenzaB__AGX23395
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcuguggaacaccgugaccggcguggacauggcccuguga

SEQ ID NO: 182284 - RNA, 1401 nt, Artificial Sequence
  derived and/or modified sequence opt4 from neuraminidase__InfluenzaB__AGX23417
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182285 - RNA, 1401 nt, Artificial Sequence; identical to SEQ ID NO: 182284
  derived and/or modified sequence opt4 from neuraminidase__InfluenzaB__AGX23428

SEQ ID NO: 182286 - RNA, 1401 nt, Artificial Sequence; identical to SEQ ID NO: 181667
  derived and/or modified sequence opt4 from neuraminidase__InfluenzaB__AGX23450

SEQ ID NO: 182287 - RNA, 1401 nt, Artificial Sequence
  derived and/or modified sequence opt4 from neuraminidase__InfluenzaB__AGX23461
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacauccaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182288 - RNA, 1401 nt, Artificial Sequence; identical to SEQ ID NO: 181667
  derived and/or modified sequence opt4 from neuraminidase__InfluenzaB__AGX23472

SEQ ID NO: 182289 - RNA, 1401 nt, Artificial Sequence; identical to SEQ ID NO: 181308
  derived and/or modified sequence opt4 from neuraminidase__InfluenzaB__AGX23483

SEQ ID NO: 182290 - RNA, 1401 nt, Artificial Sequence
  derived and/or modified sequence opt4 from neuraminidase__InfluenzaB__AGX23494
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcggcagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggacgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182291 - RNA, 1401 nt, Artificial Sequence
  derived and/or modified sequence opt4 from neuraminidase__InfluenzaB__AGX23505
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182292 - RNA, 1401 nt, Artificial Sequence
  derived and/or modified sequence opt4 from neuraminidase__InfluenzaB__AGX23516
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaaggccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182293 - RNA, 1401 nt, Artificial Sequence; identical to SEQ ID NO: 181308
  derived and/or modified sequence opt4 from neuraminidase__InfluenzaB__AGX23527

SEQ ID NO: 182294 - RNA, 1401 nt, Artificial Sequence
  derived and/or modified sequence opt4 from neuraminidase__InfluenzaB__AGX23538
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccaagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaccaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182295 - RNA, 1401 nt, Artificial Sequence
  derived and/or modified sequence opt4 from neuraminidase__InfluenzaB__AGX23549
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaccaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182296 - RNA, 1401 nt, Artificial Sequence; identical to SEQ ID NO: 181308
  derived and/or modified sequence opt4 from neuraminidase__InfluenzaB__AGX23560

SEQ ID NO: 182297 - RNA, 1401 nt, Artificial Sequence; identical to SEQ ID NO: 182290
  derived and/or modified sequence opt4 from neuraminidase__InfluenzaB__AGX23571

SEQ ID NO: 182298 - RNA, 1401 nt, Artificial Sequence; identical to SEQ ID NO: 182290
  derived and/or modified sequence opt4 from neuraminidase__InfluenzaB__AGX23582

SEQ ID NO: 182299 - RNA, 1401 nt, Artificial Sequence
  derived and/or modified sequence opt4 from neuraminidase__InfluenzaB__AGX23593
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccugacccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182300 - RNA, 1401 nt, Artificial Sequence; identical to SEQ ID NO: 181308
  derived and/or modified sequence opt4 from neuraminidase__InfluenzaB__AGX23604

SEQ ID NO: 182301 - RNA, 1401 nt, Artificial Sequence
  derived and/or modified sequence opt4 from neuraminidase__InfluenzaB__AGX23615
augcugcccagcaccauccagacccugacccuguuccugaccagcggcggcgugcugcugagccuguacgugagcgccagccugagcuaccugcuguacagcgacauccugcugaaguucagccagaccgagaucaccacccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182302 - RNA, 1401 nt, Artificial Sequence; identical to SEQ ID NO: 182290
  derived and/or modified sequence opt4 from neuraminidase__InfluenzaB__AGX23626

SEQ ID NO: 182303 - RNA, 1401 nt, Artificial Sequence; identical to SEQ ID NO: 181667
  derived and/or modified sequence opt4 from neuraminidase__InfluenzaB__AGX23637

SEQ ID NO: 182304 - RNA, 1401 nt, Artificial Sequence; identical to SEQ ID NO: 181308
  derived and/or modified sequence opt4 from neuraminidase__InfluenzaB__AGX23659

SEQ ID NO: 182305 - RNA, 1401 nt, Artificial Sequence; identical to SEQ ID NO: 181667
  derived and/or modified sequence opt4 from neuraminidase__InfluenzaB__AGX23670

SEQ ID NO: 182306 - RNA, 1401 nt, Artificial Sequence; identical to SEQ ID NO: 181667
  derived and/or modified sequence opt4 from neuraminidase__InfluenzaB__AGX23681

SEQ ID NO: 182307 - RNA, 1401 nt, Artificial Sequence; identical to SEQ ID NO: 181667
  derived and/or modified sequence opt4 from neuraminidase__InfluenzaB__AGX23692

SEQ ID NO: 182308 - RNA, 1401 nt, Artificial Sequence; identical to SEQ ID NO: 181667
  derived and/or modified sequence opt4 from neuraminidase__InfluenzaB__AGX23703

SEQ ID NO: 182309 - RNA, 1401 nt, Artificial Sequence
  derived and/or modified sequence opt4 from neuraminidase__InfluenzaB__AGX23714
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgagaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcggcagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggacgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182310 - RNA, 1401 nt, Artificial Sequence; identical to SEQ ID NO: 181667
  derived and/or modified sequence opt4 from neuraminidase__InfluenzaB__AGX23725

SEQ ID NO: 182311 - RNA, 1401 nt, Artificial Sequence; identical to SEQ ID NO: 182290
  derived and/or modified sequence opt4 from neuraminidase__InfluenzaB__AGX23736

SEQ ID NO: 182312 - RNA, 1401 nt, Artificial Sequence; identical to SEQ ID NO: 181667
  derived and/or modified sequence opt4 from neuraminidase__InfluenzaB__AGX23747

SEQ ID NO: 182313 - RNA, 1401 nt, Artificial Sequence; identical to SEQ ID NO: 181667
  derived and/or modified sequence opt4 from neuraminidase__InfluenzaB__AGX23758

SEQ ID NO: 182314 - RNA, 1401 nt, Artificial Sequence; identical to SEQ ID NO: 182290
  derived and/or modified sequence opt4 from neuraminidase__InfluenzaB__AGX23769

SEQ ID NO: 182315 - RNA, 1401 nt, Artificial Sequence
  derived and/or modified sequence opt4 from neuraminidase__InfluenzaB__AGX23780
augcugcccagcaccauccagacccugacccugcugcugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182316 - RNA, 1401 nt, Artificial Sequence
  derived and/or modified sequence opt4 from neuraminidase__InfluenzaB__AGX23791
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgcccaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182317 - RNA, 1401 nt, Artificial Sequence; identical to SEQ ID NO: 182290
  derived and/or modified sequence opt4 from neuraminidase__InfluenzaB__AGX23802

SEQ ID NO: 182318 - RNA, 1401 nt, Artificial Sequence; identical to SEQ ID NO: 182290
  derived and/or modified sequence opt4 from neuraminidase__InfluenzaB__AGX23813

SEQ ID NO: 182319 - RNA, 1401 nt, Artificial Sequence; identical to SEQ ID NO: 182290
  derived and/or modified sequence opt4 from neuraminidase__InfluenzaB__AGX23824

SEQ ID NO: 182320 - RNA, 1401 nt, Artificial Sequence; identical to SEQ ID NO: 182290
  derived and/or modified sequence opt4 from neuraminidase__InfluenzaB__AGX23846

SEQ ID NO: 182321 - RNA, 1401 nt, Artificial Sequence; identical to SEQ ID NO: 181308
  derived and/or modified sequence opt4 from neuraminidase__InfluenzaB__AGX23857

SEQ ID NO: 182322 - RNA, 1401 nt, Artificial Sequence; identical to SEQ ID NO: 182290
  derived and/or modified sequence opt4 from neuraminidase__InfluenzaB__AGX23868

SEQ ID NO: 182323 - RNA, 1401 nt, Artificial Sequence
  derived and/or modified sequence opt4 from neuraminidase__InfluenzaB__AGX23879
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaccagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182324 - RNA, 1401 nt, Artificial Sequence; identical to SEQ ID NO: 182290
  derived and/or modified sequence opt4 from neuraminidase__InfluenzaB__AGX23890

SEQ ID NO: 182325 - RNA, 1401 nt, Artificial Sequence; identical to SEQ ID NO: 181308
  derived and/or modified sequence opt4 from neuraminidase__InfluenzaB__AGX23901

SEQ ID NO: 182326 - RNA, 1401 nt, Artificial Sequence
  derived and/or modified sequence opt4 from neuraminidase__InfluenzaB__AGX23912
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacagacugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcggcagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggacgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182327 - RNA, 1401 nt, Artificial Sequence; identical to SEQ ID NO: 181480
  derived and/or modified sequence opt4 from neuraminidase__InfluenzaB__AGX23934

SEQ ID NO: 182328 - RNA, 1401 nt, Artificial Sequence
  derived and/or modified sequence opt4 from neuraminidase__InfluenzaB__AGX23945
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagaaucaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcggcagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggacgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182329 - RNA, 1401 nt, Artificial Sequence
  derived and/or modified sequence opt4 from neuraminidase__InfluenzaB__AGX23956
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcaucgacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182330 - RNA, 1401 nt, Artificial Sequence; identical to SEQ ID NO: 181667
  derived and/or modified sequence opt4 from neuraminidase__InfluenzaB__AGX23967

SEQ ID NO: 182331 - RNA, 1401 nt, Artificial Sequence; identical to SEQ ID NO: 181480
  derived and/or modified sequence opt4 from neuraminidase__InfluenzaB__AGX23978

SEQ ID NO: 182332 - RNA, 1401 nt, Artificial Sequence
  derived and/or modified sequence opt4 from neuraminidase__InfluenzaB__AGX23989
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaaggccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcggcgcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182333 - RNA, 1401 nt, Artificial Sequence; identical to SEQ ID NO: 182290
  derived and/or modified sequence opt4 from neuraminidase__InfluenzaB__AGX24000

SEQ ID NO: 182334 - RNA, 1401 nt, Artificial Sequence
  derived and/or modified sequence opt4 from neuraminidase__InfluenzaB__AGX24011
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacuacgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaucgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182335 - RNA, 1401 nt, Artificial Sequence; identical to SEQ ID NO: 181480
  derived and/or modified sequence opt4 from neuraminidase__InfluenzaB__AGX24022

SEQ ID NO: 182336 - RNA, 1401 nt, Artificial Sequence
  derived and/or modified sequence opt4 from neuraminidase__InfluenzaB__AGX24033
augcugcccagcaccauccagacccugacccuguuccugaccagcggcggcgugcugcugagccuguacgugagcgccagccugagcuaccugcuguacagcgacauccugcugaaguucagccagaccgagaucaccgcccagaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaaggccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcggcgcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182337 - RNA, 1401 nt, Artificial Sequence; identical to SEQ ID NO: 181480
  derived and/or modified sequence opt4 from neuraminidase__InfluenzaB__AGX24044

SEQ ID NO: 182338 - RNA, 1401 nt, Artificial Sequence
  derived and/or modified sequence opt4 from neuraminidase__InfluenzaB__AGX24055
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcuggaguggaccuaccccagacugagcugccccggcagcaccuuccagaaggcccugcugaucagcccccacagauucggcgagaccaagggcaacagcgccccccugaucaucagagagcccuucguggccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccaacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182339 - RNA, 1401 nt, Artificial Sequence; identical to SEQ ID NO: 181337
  derived and/or modified sequence opt4 from neuraminidase__InfluenzaB__AGX24066

SEQ ID NO: 182340 - RNA, 1401 nt, Artificial Sequence
  derived and/or modified sequence opt4 from neuraminidase__InfluenzaB__AGX24077
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcaacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaaggccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcggcgcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182341 - RNA, 1401 nt, Artificial Sequence
  derived and/or modified sequence opt4 from neuraminidase__InfluenzaB__AGX24088
augcugcccagcaccauccagacccugacccuguucaucaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcgacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcggcagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggacgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182342 - RNA, 1401 nt, Artificial Sequence; identical to SEQ ID NO: 181480
  derived and/or modified sequence opt4 from neuraminidase__InfluenzaB__AGX24099

SEQ ID NO: 182343 - RNA, 1401 nt, Artificial Sequence
  derived and/or modified sequence opt4 from neuraminidase__InfluenzaB__AGX24110
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcaccugcagagacaacagcuacaccgccaagagacccuucgugaagcugaacguggagaccgacaccgccgagaucagacugaugugcaccgagaccuaccuggacacccccagacccaacgacggcagcaucaccggccccugcggcagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggacgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182344 - RNA, 1401 nt, Artificial Sequence
  derived and/or modified sequence opt4 from neuraminidase__InfluenzaB__AGX24121
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacuacgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgccaagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182345 - RNA, 1401 nt, Artificial Sequence
  derived and/or modified sequence opt4 from neuraminidase__InfluenzaB__AGX24132
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugccccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgcccugggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182346 - RNA, 1401 nt, Artificial Sequence
  derived and/or modified sequence opt4 from neuraminidase__InfluenzaB__AGX24143
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacggcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182347 - RNA, 1401 nt, Artificial Sequence; identical to SEQ ID NO: 181480
  derived and/or modified sequence opt4 from neuraminidase__InfluenzaB__AGX24154

SEQ ID NO: 182348 - RNA, 1401 nt, Artificial Sequence
  derived and/or modified sequence opt4 from neuraminidase__InfluenzaB__AGX24165
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacuacgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugaacggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182349 - RNA, 1401 nt, Artificial Sequence; identical to SEQ ID NO: 181337
  derived and/or modified sequence opt4 from neuraminidase__InfluenzaB__AGX24176

SEQ ID NO: 182350 - RNA, 1401 nt, Artificial Sequence; identical to SEQ ID NO: 181337
  derived and/or modified sequence opt4 from neuraminidase__InfluenzaB__AGX24187

SEQ ID NO: 182351 - RNA, 1401 nt, Artificial Sequence; identical to SEQ ID NO: 181337
  derived and/or modified sequence opt4 from neuraminidase__InfluenzaB__AGX24198

SEQ ID NO: 182352 - RNA, 1401 nt, Artificial Sequence; identical to SEQ ID NO: 181667
  derived and/or modified sequence opt4 from neuraminidase__InfluenzaB__AGX24231

SEQ ID NO: 182353 - RNA, 1401 nt, Artificial Sequence; identical to SEQ ID NO: 181337
  derived and/or modified sequence opt4 from neuraminidase__InfluenzaB__AGX24242

SEQ ID NO: 182354 - RNA, 1401 nt, Artificial Sequence
  derived and/or modified sequence opt4 from neuraminidase__InfluenzaB__AGX24275
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacagaaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182355 - RNA, 1401 nt, Artificial Sequence; identical to SEQ ID NO: 181932
  derived and/or modified sequence opt4 from neuraminidase__InfluenzaB__AGX24286

SEQ ID NO: 182356 - RNA, 1401 nt, Artificial Sequence
  derived and/or modified sequence opt4 from neuraminidase__InfluenzaB__AGX24297
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182357 - RNA, 1401 nt, Artificial Sequence; identical to SEQ ID NO: 181932
  derived and/or modified sequence opt4 from neuraminidase__InfluenzaB__AGX24319

SEQ ID NO: 182358 - RNA, 1401 nt, Artificial Sequence
  derived and/or modified sequence opt4 from neuraminidase__InfluenzaB__AGX24330
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacuacgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcaccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugaugaucagcauggaggagcccggcugguacagcuucggcuucgagaucaaggacaagaagugcgacgugcccugcaucggcaucgagauggugcacgacggcggcaagaccaccugguacagcgccgccaccgccaucuacugccugaugggcagcggccagcugcugugggacaccgugaccggcguggacauggcccuguga

SEQ ID NO: 182359 - RNA, 1401 nt, Artificial Sequence
  derived and/or modified sequence opt4 from neuraminidase__InfluenzaB__AGX24341
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccugacccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182360 - RNA, 1401 nt, Artificial Sequence
  derived and/or modified sequence opt4 from neuraminidase__InfluenzaB__AGX24352
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacaacaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182361 - RNA, 1401 nt, Artificial Sequence; identical to SEQ ID NO: 182356
  derived and/or modified sequence opt4 from neuraminidase__InfluenzaB__AGX24363

SEQ ID NO: 182362 - RNA, 1401 nt, Artificial Sequence; identical to SEQ ID NO: 182360
  derived and/or modified sequence opt4 from neuraminidase__InfluenzaB__AGX24374

SEQ ID NO: 182363 - RNA, 1401 nt, Artificial Sequence
  derived and/or modified sequence opt4 from neuraminidase__InfluenzaB__AGX24385
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182364 - RNA, 1401 nt, Artificial Sequence
  derived and/or modified sequence opt4 from neuraminidase__InfluenzaB__AGX24396
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcggcgcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182365 - RNA, 1401 nt, Artificial Sequence; identical to SEQ ID NO: 182364
  derived and/or modified sequence opt4 from neuraminidase__InfluenzaB__AGX24407

SEQ ID NO: 182366 - RNA, 1401 nt, Artificial Sequence; identical to SEQ ID NO: 181337
  derived and/or modified sequence opt4 from neuraminidase__InfluenzaB__AGX24418

SEQ ID NO: 182367 - RNA, 1401 nt, Artificial Sequence; identical to SEQ ID NO: 181308
  derived and/or modified sequence opt4 from neuraminidase__InfluenzaB__AGX24429

SEQ ID NO: 182368 - RNA, 1401 nt, Artificial Sequence
  derived and/or modified sequence opt4 from neuraminidase__InfluenzaB__AGX24440
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggcaccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcggcgcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccaccaucuacugccugaugggcagcggccagcugcugugggacaccgugaccggcguggacauggcccuguga

SEQ ID NO: 182369 - RNA, 1401 nt, Artificial Sequence; identical to SEQ ID NO: 181932
  derived and/or modified sequence opt4 from neuraminidase__InfluenzaB__AGX24451

SEQ ID NO: 182370 - RNA, 1401 nt, Artificial Sequence
  derived and/or modified sequence opt4 from neuraminidase__InfluenzaB__AGX24462
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacuacgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugaugaucagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182371 - RNA, 1401 nt, Artificial Sequence; identical to SEQ ID NO: 182370
  derived and/or modified sequence opt4 from neuraminidase__InfluenzaB__AGX24473

SEQ ID NO: 182372 - RNA, 1401 nt, Artificial Sequence
  derived and/or modified sequence opt4 from neuraminidase__InfluenzaB__AGX24484
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacggcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182373 - RNA, 1401 nt, Artificial Sequence
  derived and/or modified sequence opt4 from neuraminidase__InfluenzaB__AGX24495
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcagguggugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182374 - RNA, 1401 nt, Artificial Sequence; identical to SEQ ID NO: 181932
  derived and/or modified sequence opt4 from neuraminidase__InfluenzaB__AGX24506

SEQ ID NO: 182375 - RNA, 1401 nt, Artificial Sequence
  derived and/or modified sequence opt4 from neuraminidase__InfluenzaB__AGX24517
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182376 - RNA, 1401 nt, Artificial Sequence; identical to SEQ ID NO: 181932
  derived and/or modified sequence opt4 from neuraminidase__InfluenzaB__AGX24528

SEQ ID NO: 182377 - RNA, 1401 nt, Artificial Sequence; identical to SEQ ID NO: 182360
  derived and/or modified sequence opt4 from neuraminidase__InfluenzaB__AGX24539

SEQ ID NO: 182378 - RNA, 1401 nt, Artificial Sequence
  derived and/or modified sequence opt4 from neuraminidase__InfluenzaB__AGX24550
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugauccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182379 - RNA, 1401 nt, Artificial Sequence; identical to SEQ ID NO: 182370
  derived and/or modified sequence opt4 from neuraminidase__InfluenzaB__AGX24561

SEQ ID NO: 182380 - RNA, 1401 nt, Artificial Sequence; identical to SEQ ID NO: 181337
  derived and/or modified sequence opt4 from neuraminidase__InfluenzaB__AGX24572

SEQ ID NO: 182381 - RNA, 1401 nt, Artificial Sequence
  derived and/or modified sequence opt4 from neuraminidase__InfluenzaB__AGX24583
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccuggaccgacagcggcgcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182382 - RNA, 1401 nt, Artificial Sequence; identical to SEQ ID NO: 181932
  derived and/or modified sequence opt4 from neuraminidase__InfluenzaB__AGX24594

SEQ ID NO: 182383 - RNA, 1401 nt, Artificial Sequence; identical to SEQ ID NO: 181932
  derived and/or modified sequence opt4 from neuraminidase__InfluenzaB__AGX24605

SEQ ID NO: 182384 - RNA, 1401 nt, Artificial Sequence; identical to SEQ ID NO: 181932
  derived and/or modified sequence opt4 from neuraminidase__InfluenzaB__AGX24616

SEQ ID NO: 182385 - RNA, 1401 nt, Artificial Sequence; identical to SEQ ID NO: 182356
  derived and/or modified sequence opt4 from neuraminidase__InfluenzaB__AGX24627

SEQ ID NO: 182386 - RNA, 1401 nt, Artificial Sequence; identical to SEQ ID NO: 181932
  derived and/or modified sequence opt4 from neuraminidase__InfluenzaB__AGX24638

SEQ ID NO: 182387 - RNA, 1401 nt, Artificial Sequence
  derived and/or modified sequence opt4 from neuraminidase__InfluenzaB__AGX24660
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugaccuacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182388 - RNA, 1401 nt, Artificial Sequence
  derived and/or modified sequence opt4 from neuraminidase__InfluenzaB__AGX24671
augcugcccagcaccauccagacccugacccuguuccugaccagcggcggcgugcugcugcugcuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacauccccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182389 - RNA, 1401 nt, Artificial Sequence
  derived and/or modified sequence opt4 from neuraminidase__InfluenzaB__AGX24682
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggugcugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182390 - RNA, 1401 nt, Artificial Sequence; identical to SEQ ID NO: 181932
  derived and/or modified sequence opt4 from neuraminidase__InfluenzaB__AGX24693

SEQ ID NO: 182391 - RNA, 1401 nt, Artificial Sequence; identical to SEQ ID NO: 181932
  derived and/or modified sequence opt4 from neuraminidase__InfluenzaB__AGX24704

SEQ ID NO: 182392 - RNA, 1401 nt, Artificial Sequence; identical to SEQ ID NO: 181932
  derived and/or modified sequence opt4 from neuraminidase__InfluenzaB__AGX24715

SEQ ID NO: 182393 - RNA, 1401 nt, Artificial Sequence
  derived and/or modified sequence opt4 from neuraminidase__InfluenzaB__AGX24737
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggcaccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcggcgcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182394 - RNA, 1401 nt, Artificial Sequence
  derived and/or modified sequence opt4 from neuraminidase__InfluenzaB__AGX24748
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcagauacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccguguacugccugaugggcagcggccagcugcugugggacaccgugaccggcguggacauggcccuguga

SEQ ID NO: 182395 - RNA, 1401 nt, Artificial Sequence
  derived and/or modified sequence opt4 from neuraminidase__InfluenzaB__AGX24759
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacauccccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182396 - RNA, 1401 nt, Artificial Sequence; identical to SEQ ID NO: 181932
  derived and/or modified sequence opt4 from neuraminidase__InfluenzaB__AGX24770

SEQ ID NO: 182397 - RNA, 1401 nt, Artificial Sequence; identical to SEQ ID NO: 182394
  derived and/or modified sequence opt4 from neuraminidase__InfluenzaB__AGX24781

SEQ ID NO: 182398 - RNA, 1401 nt, Artificial Sequence; identical to SEQ ID NO: 181308
  derived and/or modified sequence opt4 from neuraminidase__InfluenzaB__AGX24792

SEQ ID NO: 182399 - RNA, 1401 nt, Artificial Sequence; identical to SEQ ID NO: 182356
  derived and/or modified sequence opt4 from neuraminidase__InfluenzaB__AGX24803

SEQ ID NO: 182400 - RNA, 1401 nt, Artificial Sequence; identical to SEQ ID NO: 181932
  derived and/or modified sequence opt4 from neuraminidase__InfluenzaB__AGX24814

SEQ ID NO: 182401 - RNA, 1401 nt, Artificial Sequence
  derived and/or modified sequence opt4 from neuraminidase__InfluenzaB__AGX24825
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcgaguacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182402 - RNA, 1401 nt, Artificial Sequence; identical to SEQ ID NO: 181932
  derived and/or modified sequence opt4 from neuraminidase__InfluenzaB__AGX24836

SEQ ID NO: 182403 - RNA, 1401 nt, Artificial Sequence
  derived and/or modified sequence opt4 from neuraminidase__InfluenzaB__AGX24847
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccguguacugccugaugggcagcggccagcugcugugggacaccgugaccggcgugaacaugacccuguga

SEQ ID NO: 182404 - RNA, 1401 nt, Artificial Sequence; identical to SEQ ID NO: 181416
  derived and/or modified sequence opt4 from neuraminidase__InfluenzaB__AGX24858

SEQ ID NO: 182405 - RNA, 1401 nt, Artificial Sequence
  derived and/or modified sequence opt4 from neuraminidase__InfluenzaB__AGX24869
augcugcccagcaccauccagacccugacccuguuccugaccagcggcggcgugcugcugagccuguacgugagcgccagccugagcuaccugcuguacagcgacauccugcugaaguucagcagaaccgagaugaccgcccccaucaugccccugggcugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182406 - RNA, 1401 nt, Artificial Sequence
  derived and/or modified sequence opt4 from neuraminidase__InfluenzaB__AGX24880
augcugcccagcaccauccagaugcugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182407 - RNA, 1401 nt, Artificial Sequence
  derived and/or modified sequence opt4 from neuraminidase__InfluenzaB__AGX24902
augcugcccagcaccauccagacccugacccuguuccugaccagcggcggcgugcugcugagccuguacgugagcgcccugcugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaacaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacaacuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182408 - RNA, 1401 nt, Artificial Sequence; identical to SEQ ID NO: 181421
  derived and/or modified sequence opt4 from neuraminidase__InfluenzaB__AGX84846

SEQ ID NO: 182409 - RNA, 1401 nt, Artificial Sequence; identical to SEQ ID NO: 181476
  derived and/or modified sequence opt4 from neuraminidase__InfluenzaB__AGX84858

SEQ ID NO: 182410 - RNA, 1401 nt, Artificial Sequence; identical to SEQ ID NO: 181421
  derived and/or modified sequence opt4 from neuraminidase__InfluenzaB__AGX84869

SEQ ID NO: 182411 - RNA, 1401 nt, Artificial Sequence
  derived and/or modified sequence opt4 from neuraminidase__InfluenzaB__AGX84880
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugagccuggacugcgccaacgccagcaacgugcaggccgugaacagaagcgccaccaagggcgugaucuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182412 - RNA, 1401 nt, Artificial Sequence; identical to SEQ ID NO: 181421
  derived and/or modified sequence opt4 from neuraminidase__InfluenzaB__AGX84891

SEQ ID NO: 182413 - RNA, 1401 nt, Artificial Sequence; identical to SEQ ID NO: 181476
  derived and/or modified sequence opt4 from neuraminidase__InfluenzaB__AGX84902

SEQ ID NO: 182414 - RNA, 1401 nt, Artificial Sequence
  derived and/or modified sequence opt4 from neuraminidase__InfluenzaB__AGX84924
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacuacgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182415 - RNA, 1401 nt, Artificial Sequence
  derived and/or modified sequence opt4 from neuraminidase__InfluenzaB__AGY46393
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccaccaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaacgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 182416 - RNA, 1401 nt, Artificial Sequence
  derived and/or modified sequence opt4 from neuraminidase__InfluenzaB__AGY46397
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182417 - RNA, 1401 nt, Artificial Sequence
  derived and/or modified sequence opt4 from neuraminidase__InfluenzaB__AGY46399
augcugcccagcaccauccagacccugacccuguuccugaccagcggcggcgugcugcugagccuguacgugagcgccagccugagcuaccugcuguacagcgacauccugcugaaguucagccccaccgagaucaucgcccccaccaccccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgaggcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182418 - RNA, 1401 nt, Artificial Sequence
  derived and/or modified sequence opt4 from neuraminidase__InfluenzaB__AGY46401
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182419 - RNA, 1401 nt, Artificial Sequence; identical to SEQ ID NO: 181136
  derived and/or modified sequence opt4 from neuraminidase__InfluenzaB__AGZ59825

SEQ ID NO: 182420 - RNA, 1401 nt, Artificial Sequence; identical to SEQ ID NO: 181202
  derived and/or modified sequence opt4 from neuraminidase__InfluenzaB__AGZ59836

SEQ ID NO: 182421 - RNA, 1401 nt, Artificial Sequence; identical to SEQ ID NO: 181891
  derived and/or modified sequence opt4 from neuraminidase__InfluenzaB__AGZ59847

SEQ ID NO: 182422 - RNA, 1401 nt, Artificial Sequence
  derived and/or modified sequence opt4 from neuraminidase__InfluenzaB__AGZ59858
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaagagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182423 - RNA, 1401 nt, Artificial Sequence
  derived and/or modified sequence opt4 from neuraminidase__InfluenzaB__AGZ59869
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggccgugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182424 - RNA, 1401 nt, Artificial Sequence; identical to SEQ ID NO: 181920
  derived and/or modified sequence opt4 from neuraminidase__InfluenzaB__AGZ59880

SEQ ID NO: 182425 - RNA, 1401 nt, Artificial Sequence; identical to SEQ ID NO: 182364
  derived and/or modified sequence opt4 from neuraminidase__InfluenzaB__AGZ59891

SEQ ID NO: 182426 - RNA, 1401 nt, Artificial Sequence; identical to SEQ ID NO: 181481
  derived and/or modified sequence opt4 from neuraminidase__InfluenzaB__AGZ59902

SEQ ID NO: 182427 - RNA, 1401 nt, Artificial Sequence; identical to SEQ ID NO: 181481
  derived and/or modified sequence opt4 from neuraminidase__InfluenzaB__AGZ59913

SEQ ID NO: 182428 - RNA, 1401 nt, Artificial Sequence; identical to SEQ ID NO: 181481
  derived and/or modified sequence opt4 from neuraminidase__InfluenzaB__AGZ59924

SEQ ID NO: 182429 - RNA, 1401 nt, Artificial Sequence; identical to SEQ ID NO: 181481
  derived and/or modified sequence opt4 from neuraminidase__InfluenzaB__AGZ59935

SEQ ID NO: 182430 - RNA, 1401 nt, Artificial Sequence; identical to SEQ ID NO: 181481
  derived and/or modified sequence opt4 from neuraminidase__InfluenzaB__AGZ59946

SEQ ID NO: 182431 - RNA, 1401 nt, Artificial Sequence
  derived and/or modified sequence opt4 from neuraminidase__InfluenzaB__AGZ59957
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaagggcaccuggcacagcgccgccaccgccaucuacugccugaugggcagcggccagcugcugugggacaccgugaccggcguggacauggcccuguga

SEQ ID NO: 182432 - RNA, 1401 nt, Artificial Sequence; identical to SEQ ID NO: 181481
  derived and/or modified sequence opt4 from neuraminidase__InfluenzaB__AGZ59969

SEQ ID NO: 182433 - RNA, 1401 nt, Artificial Sequence; identical to SEQ ID NO: 181481
  derived and/or modified sequence opt4 from neuraminidase__InfluenzaB__AGZ59980

SEQ ID NO: 182434 - RNA, 1401 nt, Artificial Sequence; identical to SEQ ID NO: 181481
  derived and/or modified sequence opt4 from neuraminidase__InfluenzaB__AGZ59991

SEQ ID NO: 182435 - RNA, 1401 nt, Artificial Sequence; identical to SEQ ID NO: 181481
  derived and/or modified sequence opt4 from neuraminidase__InfluenzaB__AGZ60003

SEQ ID NO: 182436 - RNA, 1401 nt, Artificial Sequence
  derived and/or modified sequence opt4 from neuraminidase__InfluenzaB__AGZ60014
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagagagcccugcugaucagcccccacagauucggcgaggccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggccagaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182437 - RNA, 1401 nt, Artificial Sequence; identical to SEQ ID NO: 181415
  derived and/or modified sequence opt4 from neuraminidase__InfluenzaB__AGZ60025

SEQ ID NO: 182438 - RNA, 1401 nt, Artificial Sequence
  derived and/or modified sequence opt4 from neuraminidase__InfluenzaB__AGZ60037
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgagagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacaucgcccuguga

SEQ ID NO: 182439 - RNA, 1401 nt, Artificial Sequence; identical to SEQ ID NO: 181651
  derived and/or modified sequence opt4 from neuraminidase__InfluenzaB__AGZ60048

SEQ ID NO: 182440 - RNA, 1401 nt, Artificial Sequence; identical to SEQ ID NO: 181651
  derived and/or modified sequence opt4 from neuraminidase__InfluenzaB__AGZ60059

SEQ ID NO: 182441 - RNA, 1401 nt, Artificial Sequence
  derived and/or modified sequence opt4 from neuraminidase__InfluenzaB__AGZ60070
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugccccuggacugcgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgcccacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccaacaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccugguguucagcggcgugaugaucagcguggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacaugacccuguga

SEQ ID NO: 182442 - RNA, 1401 nt, Artificial Sequence; identical to SEQ ID NO: 181147
  derived and/or modified sequence opt4 from neuraminidase__InfluenzaB__AGZ60081

SEQ ID NO: 182443 - RNA, 1401 nt, Artificial Sequence; identical to SEQ ID NO: 181667
  derived and/or modified sequence opt4 from neuraminidase__InfluenzaB__AGZ60092

SEQ ID NO: 182444 - RNA, 1401 nt, Artificial Sequence; identical to SEQ ID NO: 182290
  derived and/or modified sequence opt4 from neuraminidase__InfluenzaB__AGZ60103

SEQ ID NO: 182445 - RNA, 1401 nt, Artificial Sequence; identical to SEQ ID NO: 181308
  derived and/or modified sequence opt4 from neuraminidase__InfluenzaB__AGZ60135

SEQ ID NO: 182446 - RNA, 1401 nt, Artificial Sequence; identical to SEQ ID NO: 181480
  derived and/or modified sequence opt4 from neuraminidase__InfluenzaB__AGZ60154

SEQ ID NO: 182447 - RNA, 1401 nt, Artificial Sequence
  derived and/or modified sequence opt4 from neuraminidase__InfluenzaB__AGZ60164
augcugcccagcaccacccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucaacccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182448 - RNA, 1401 nt, Artificial Sequence; identical to SEQ ID NO: 182360
  derived and/or modified sequence opt4 from neuraminidase__InfluenzaB__AGZ60176

SEQ ID NO: 182449 - RNA, 1401 nt, Artificial Sequence; identical to SEQ ID NO: 181337
  derived and/or modified sequence opt4 from neuraminidase__InfluenzaB__AGZ60187

SEQ ID NO: 182450 - RNA, 1401 nt, Artificial Sequence; identical to SEQ ID NO: 181337
  derived and/or modified sequence opt4 from neuraminidase__InfluenzaB__AGZ60198

SEQ ID NO: 182451 - RNA, 1401 nt, Artificial Sequence; identical to SEQ ID NO: 181337
  derived and/or modified sequence opt4 from neuraminidase__InfluenzaB__AGZ60210

SEQ ID NO: 182452 - RNA, 1401 nt, Artificial Sequence
  derived and/or modified sequence opt4 from neuraminidase__InfluenzaB__AGZ60221
augcugcccaccaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182453 - RNA, 1401 nt, Artificial Sequence
  derived and/or modified sequence opt4 from neuraminidase__InfluenzaB__AGZ60272
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccaagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182454 - RNA, 1398 nt, Artificial Sequence
  derived and/or modified sequence opt4 from neuraminidase__InfluenzaB__AHL91182
augcugcccagcaccauccagacccugacccuguuccugaccagcggcggcgugcugcugagccuguacgugagcgcccugcugagcuaccugcuguacagcgacauccugcugaaguucagccccaagaucaucgcccccaccaugagccuggacugcgccaacgccagcaacgugcaggccgugaaccacagcgccaccaaggagaugaaguuccugccccccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcgugaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagagaaccuggcacagcgccgccaccgccaucuacugccugaugggcagcggccagcugcugugggacaccgugaccggcguggacauggcccuguga

SEQ ID NO: 182455 - RNA, 1398 nt, Artificial Sequence
  derived and/or modified sequence opt4 from neuraminidase__InfluenzaB__AHL91193
augcugcccagcaccauccagacccugacccuguuccugaccagcggcggcgugcugcugagccuguacgugagcgcccugcugagcuaccugcuguacagcgacauccugcugaaguucagccccaagaucaucgcccccaccaugagccuggacugcgccaacgccagcaacgugcaggccgugaaccacagcgccaccaaggagaugaaguuccugcccagcgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcgugaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagagaaccuggcacagcgccgccaccgccaucuacugccugaugggcagcggccagcugcugugggacaccgugaccggcguggacauggcccuguga

SEQ ID NO: 182456 - RNA, 1398 nt, Artificial Sequence
  derived and/or modified sequence opt4 from neuraminidase__InfluenzaB__AHL91204
augcugcccagcaccauccagacccugacccuguuccugaccagcggcggcgugcugcugagccuguacgugagcgcccugcugagcuaccugcuguacagcgacgugcugcugaaguucagccccaagaucaucgcccccaccaugagccuggacugcgccaacgccagcaacgugcaggccgugaaccacagcgccaccgaggagaugaccuuccugcugcccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacaucuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggccacggcggcaucaagggcggcuucgugcaccagagaauggccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 182457 - RNA, 1398 nt, Artificial Sequence
  derived and/or modified sequence opt4 from neuraminidase__InfluenzaB__AHL91215
augcugcccagcaccauccagacccugacccuguuccugaccagcggcggcgugcugcugagccuguacgugagcacccugcugagcuaccugcuguacagcgacauccugcugaaguucagccccaagaucaucgcccccaccaccagccuggacugcgccaacgccagcaacgugcaggccgugaaccacagcgccaccaaggagaugaaguuccugcccaccgagcccgaguggaccuaccccagacugagcugccagggcagcaccuuccagaaggcccugcugaucagcccccacagauucggcgaggccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaaccugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcgugaagggcggcuucgugcaccagagaaugaccagcaagaucggcagaugguacagcagaaccaugagcaagaccaagagaaugggcauggagcuguacgugaaguacgacggcgaccccuggaccgacagcgacgcccuggcccccagcggcgugauggugagcauggaggagcccggcugguacagcuucggcuucgagaucaaggacaagaagugcgacgugcccugcaucggcaucgagauggugcacgacggcggcaagagaaccuggcacagcgccgccaccgccaucuacugccugaugggcagcggccagcugcugugggacaccgugaccggcguggacauggcccuguga

SEQ ID NO: 182458 - RNA, 1401 nt, Artificial Sequence; identical to SEQ ID NO: 181229
  derived and/or modified sequence opt4 from neuraminidase__InfluenzaB__AHL91226

SEQ ID NO: 182459 - RNA, 1401 nt, Artificial Sequence; identical to SEQ ID NO: 181230
  derived and/or modified sequence opt4 from neuraminidase__InfluenzaB__AHL91237

SEQ ID NO: 182460 - RNA, 1401 nt, Artificial Sequence; identical to SEQ ID NO: 181230
  derived and/or modified sequence opt4 from neuraminidase__InfluenzaB__AHL91248

SEQ ID NO: 182461 - RNA, 1401 nt, Artificial Sequence; identical to SEQ ID NO: 181229
  derived and/or modified sequence opt4 from neuraminidase__InfluenzaB__AHL91259

SEQ ID NO: 182462 - RNA, 1401 nt, Artificial Sequence; identical to SEQ ID NO: 181229
  derived and/or modified sequence opt4 from neuraminidase__InfluenzaB__AHL91270

SEQ ID NO: 182463 - RNA, 1398 nt, Artificial Sequence; identical to SEQ ID NO: 181201
  derived and/or modified sequence opt4 from neuraminidase__InfluenzaB__AHL91281

SEQ ID NO: 182464 - RNA, 1401 nt, Artificial Sequence
  derived and/or modified sequence opt4 from neuraminidase__InfluenzaB__AHL91303
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucaacgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccagaagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacauggcccuguga

SEQ ID NO: 182465 - RNA, 1401 nt, Artificial Sequence; identical to SEQ ID NO: 181230
  derived and/or modified sequence opt4 from neuraminidase__InfluenzaB__AHL91314

SEQ ID NO: 182466 - RNA, 1401 nt, Artificial Sequence; identical to SEQ ID NO: 181230
  derived and/or modified sequence opt4 from neuraminidase__InfluenzaB__AHL91325

SEQ ID NO: 182467 - RNA, 1401 nt, Artificial Sequence
  derived and/or modified sequence opt4 from neuraminidase__InfluenzaB__AHL91347
augcugcccagcaccauccagacccugacccuguuccugaccagcggcggcgugcugcugagccuguacgugagcgccagccugagcuaccugcuguacagcgacgugcugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucgugaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgaggacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182468 - RNA, 1401 nt, Artificial Sequence; identical to SEQ ID NO: 182467
  derived and/or modified sequence opt4 from neuraminidase__InfluenzaB__AHL91358

SEQ ID NO: 182469 - RNA, 1401 nt, Artificial Sequence; identical to SEQ ID NO: 181205
  derived and/or modified sequence opt4 from neuraminidase__InfluenzaB__AHL91369

SEQ ID NO: 182470 - RNA, 1401 nt, Artificial Sequence; identical to SEQ ID NO: 181205
  derived and/or modified sequence opt4 from neuraminidase__InfluenzaB__AHL91380

SEQ ID NO: 182471 - RNA, 1401 nt, Artificial Sequence
  derived and/or modified sequence opt4 from neuraminidase__InfluenzaB__AHL91391
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccugaacugcgccaacgccagcaacgugcaggccgugaacagaagcgccaccaagggcgugacccugccccugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaucgacagcgacgcccugacccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182472 - RNA, 1401 nt, Artificial Sequence
  derived and/or modified sequence opt4 from neuraminidase__InfluenzaB__AHL91413
augcugcccagcaccauccagacccugacccuguuccugaccagcggcggcgugcugcugagccuguacgugagcgccagccugagcuaccugcuguacagcgacauccugcugaaguucacccccaccgagaucaccgcccccaccaugccccuggacugcgccaacgccagcaacgugcaggccgugaaccugagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182473 - RNA, 1401 nt, Artificial Sequence
  derived and/or modified sequence opt4 from neuraminidase__InfluenzaB__AHL91446
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcaugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcggcaagggcagcggcggcaucaagggcggcuucgugcaccagagaauggagagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaaggagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 182474 - RNA, 1401 nt, Artificial Sequence
  derived and/or modified sequence opt4 from neuraminidase__InfluenzaB__AHL91457
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacacccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182475 - RNA, 1401 nt, Artificial Sequence
  derived and/or modified sequence opt4 from neuraminidase__InfluenzaB__AHL91468
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcgugggcgagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182476 - RNA, 1401 nt, Artificial Sequence
  derived and/or modified sequence opt4 from neuraminidase__InfluenzaB__AHL91479
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugcccagcgacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182477 - RNA, 1401 nt, Artificial Sequence
  derived and/or modified sequence opt4 from neuraminidase__InfluenzaB__AHL91501
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcaugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcggcaagggcagcggcggcaucaagggcggcuucgugcaccagagaauggagagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 182478 - RNA, 1401 nt, Artificial Sequence
  derived and/or modified sequence opt4 from neuraminidase__InfluenzaB__AHL91512
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaucuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182479 - RNA, 1401 nt, Artificial Sequence
  derived and/or modified sequence opt4 from neuraminidase__InfluenzaB__AHL91523
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182480 - RNA, 1401 nt, Artificial Sequence; identical to SEQ ID NO: 182477
  derived and/or modified sequence opt4 from neuraminidase__InfluenzaB__AHL91534

SEQ ID NO: 182481 - RNA, 1401 nt, Artificial Sequence
  derived and/or modified sequence opt4 from neuraminidase__InfluenzaB__AHL91545
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaaugaccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaagggcaccuggcacagcgccgccaccgccaucuacugccugaugggcagcggccagcugcugugggacaccgugaccggcguggacauggcccuguga

SEQ ID NO: 182482 - RNA, 1401 nt, Artificial Sequence; identical to SEQ ID NO: 182477
  derived and/or modified sequence opt4 from neuraminidase__InfluenzaB__AHL91556

SEQ ID NO: 182483 - RNA, 1401 nt, Artificial Sequence; identical to SEQ ID NO: 182477
  derived and/or modified sequence opt4 from neuraminidase__InfluenzaB__AHL91578

SEQ ID NO: 182484 - RNA, 1401 nt, Artificial Sequence; identical to SEQ ID NO: 181405
  derived and/or modified sequence opt4 from neuraminidase__InfluenzaB__AHL91589

SEQ ID NO: 182485 - RNA, 1401 nt, Artificial Sequence
  derived and/or modified sequence opt4 from neuraminidase__InfluenzaB__AHL91600
augcugcccagcaccauccagacccugacccuguuccugaccaccggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182486 - RNA, 1401 nt, Artificial Sequence; identical to SEQ ID NO: 182485
  derived and/or modified sequence opt4 from neuraminidase__InfluenzaB__AHL91611

SEQ ID NO: 182487 - RNA, 1401 nt, Artificial Sequence; identical to SEQ ID NO: 182477
  derived and/or modified sequence opt4 from neuraminidase__InfluenzaB__AHL91622

SEQ ID NO: 182488 - RNA, 1401 nt, Artificial Sequence; identical to SEQ ID NO: 182478
  derived and/or modified sequence opt4 from neuraminidase__InfluenzaB__AHL91633

SEQ ID NO: 182489 - RNA, 1401 nt, Artificial Sequence; identical to SEQ ID NO: 182478
  derived and/or modified sequence opt4 from neuraminidase__InfluenzaB__AHL91644

SEQ ID NO: 182490 - RNA, 1401 nt, Artificial Sequence
  derived and/or modified sequence opt4 from neuraminidase__InfluenzaB__AHL91655
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaaggaggugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182491 - RNA, 1401 nt, Artificial Sequence; identical to SEQ ID NO: 182477
  derived and/or modified sequence opt4 from neuraminidase__InfluenzaB__AHL91666

SEQ ID NO: 182492 - RNA, 1401 nt, Artificial Sequence; identical to SEQ ID NO: 182478
  derived and/or modified sequence opt4 from neuraminidase__InfluenzaB__AHL91677

SEQ ID NO: 182493 - RNA, 1401 nt, Artificial Sequence; identical to SEQ ID NO: 182479
  derived and/or modified sequence opt4 from neuraminidase__InfluenzaB__AHL91688

SEQ ID NO: 182494 - RNA, 1401 nt, Artificial Sequence; identical to SEQ ID NO: 181207
  derived and/or modified sequence opt4 from neuraminidase__InfluenzaB__AHL91699

SEQ ID NO: 182495 - RNA, 1401 nt, Artificial Sequence
  derived and/or modified sequence opt4 from neuraminidase__InfluenzaB__AHL91710
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182496 - RNA, 1401 nt, Artificial Sequence; identical to SEQ ID NO: 181134
  derived and/or modified sequence opt4 from neuraminidase__InfluenzaB__AHL91721

SEQ ID NO: 182497 - RNA, 1401 nt, Artificial Sequence; identical to SEQ ID NO: 181202
  derived and/or modified sequence opt4 from neuraminidase__InfluenzaB__AHL91732

SEQ ID NO: 182498 - RNA, 1401 nt, Artificial Sequence; identical to SEQ ID NO: 181134
  derived and/or modified sequence opt4 from neuraminidase__InfluenzaB__AHL91743

SEQ ID NO: 182499 - RNA, 1401 nt, Artificial Sequence
  derived and/or modified sequence opt4 from neuraminidase__InfluenzaB__AHL91754
augcugcccagcaccauccagacccugacccugcugcugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182500 - RNA, 1401 nt, Artificial Sequence; identical to SEQ ID NO: 181134
  derived and/or modified sequence opt4 from neuraminidase__InfluenzaB__AHL91765

SEQ ID NO: 182501 - RNA, 1401 nt, Artificial Sequence
  derived and/or modified sequence opt4 from neuraminidase__InfluenzaB__AHL91776
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaccagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182502 - RNA, 1401 nt, Artificial Sequence; identical to SEQ ID NO: 182501
  derived and/or modified sequence opt4 from neuraminidase__InfluenzaB__AHL91787

SEQ ID NO: 182503 - RNA, 1401 nt, Artificial Sequence; identical to SEQ ID NO: 182501
  derived and/or modified sequence opt4 from neuraminidase__InfluenzaB__AHL91798

SEQ ID NO: 182504 - RNA, 1401 nt, Artificial Sequence; identical to SEQ ID NO: 181138
  derived and/or modified sequence opt4 from neuraminidase__InfluenzaB__AHL91809

SEQ ID NO: 182505 - RNA, 1401 nt, Artificial Sequence
  derived and/or modified sequence opt4 from neuraminidase__InfluenzaB__AHL91820
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182506 - RNA, 1401 nt, Artificial Sequence
  derived and/or modified sequence opt4 from neuraminidase__InfluenzaB__AHL91831
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagcggcggcaucaagggcggcuucgugcaccagagaaugaccagcaagaucggcagaugguacagcagaaccaugagcaagaccgagagaaugggcaugggccuguacgugaaguacgacggcgaccccugggccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182507 - RNA, 1401 nt, Artificial Sequence; identical to SEQ ID NO: 181651
  derived and/or modified sequence opt4 from neuraminidase__InfluenzaB__AHL91842

SEQ ID NO: 182508 - RNA, 1401 nt, Artificial Sequence
  derived and/or modified sequence opt4 from neuraminidase__InfluenzaB__AHL91853
augcugcccagcaccauccagacccugacccuguuccugaccagcggcggcgugcugcugagccuguacgugagcgccagccugagcuaccugcuguacagcgacauccugcugaaguucagcaccaccgagaucaccgcccccaccaugcccagcgacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgacgcccuggcccugagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182509 - RNA, 1401 nt, Artificial Sequence; identical to SEQ ID NO: 181649
  derived and/or modified sequence opt4 from neuraminidase__InfluenzaB__AHL91864

SEQ ID NO: 182510 - RNA, 1401 nt, Artificial Sequence; identical to SEQ ID NO: 181649
  derived and/or modified sequence opt4 from neuraminidase__InfluenzaB__AHL91875

SEQ ID NO: 182511 - RNA, 1401 nt, Artificial Sequence; identical to SEQ ID NO: 181406
  derived and/or modified sequence opt4 from neuraminidase__InfluenzaB__AHL91886

SEQ ID NO: 182512 - RNA, 1401 nt, Artificial Sequence; identical to SEQ ID NO: 181147
  derived and/or modified sequence opt4 from neuraminidase__InfluenzaB__AHL91897

SEQ ID NO: 182513 - RNA, 1401 nt, Artificial Sequence; identical to SEQ ID NO: 181147
  derived and/or modified sequence opt4 from neuraminidase__InfluenzaB__AHL91908

SEQ ID NO: 182514 - RNA, 1401 nt, Artificial Sequence
  derived and/or modified sequence opt4 from neuraminidase__InfluenzaB__AHL91919
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182515 - RNA, 1401 nt, Artificial Sequence; identical to SEQ ID NO: 182209
  derived and/or modified sequence opt4 from neuraminidase__InfluenzaB__AHL91930

SEQ ID NO: 182516 - RNA, 1401 nt, Artificial Sequence; identical to SEQ ID NO: 181147
  derived and/or modified sequence opt4 from neuraminidase__InfluenzaB__AHL91941

SEQ ID NO: 182517 - RNA, 1401 nt, Artificial Sequence; identical to SEQ ID NO: 181147
  derived and/or modified sequence opt4 from neuraminidase__InfluenzaB__AHL91952

SEQ ID NO: 182518 - RNA, 1401 nt, Artificial Sequence; identical to SEQ ID NO: 181190
  derived and/or modified sequence opt4 from neuraminidase__InfluenzaB__AHL91963

SEQ ID NO: 182519 - RNA, 1401 nt, Artificial Sequence
  derived and/or modified sequence opt4 from neuraminidase__InfluenzaB__AHL91974
augcugcccagcaccauccagacccugacccuguuccugaccagcggcggcgugcugcugagccuguacgugagcgccagccugagcuaccugcuguacagcgacauccugcugaaguucagccccaccgagaucaccacccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182520 - RNA, 1401 nt, Artificial Sequence; identical to SEQ ID NO: 181190
  derived and/or modified sequence opt4 from neuraminidase__InfluenzaB__AHL91985

SEQ ID NO: 182521 - RNA, 1401 nt, Artificial Sequence; identical to SEQ ID NO: 181147
  derived and/or modified sequence opt4 from neuraminidase__InfluenzaB__AHL91995

SEQ ID NO: 182522 - RNA, 1401 nt, Artificial Sequence
  derived and/or modified sequence opt4 from neuraminidase__InfluenzaB__AHL92006
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcguggagauggugcacgacggcggcaaggagaccuggcacagcgccgccaccgccaucuacugccugaugggcagcggccagcugcugugggacaccgugaccggcguggacauggcccuguga

SEQ ID NO: 182523 - RNA, 1401 nt, Artificial Sequence; identical to SEQ ID NO: 181155
  derived and/or modified sequence opt4 from neuraminidase__InfluenzaB__AHL92017

SEQ ID NO: 182524 - RNA, 1401 nt, Artificial Sequence; identical to SEQ ID NO: 181155
  derived and/or modified sequence opt4 from neuraminidase__InfluenzaB__AHL92028

SEQ ID NO: 182525 - RNA, 1401 nt, Artificial Sequence
  derived and/or modified sequence opt4 from neuraminidase__InfluenzaB__AHL92039
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaucuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacaacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182526 - RNA, 1401 nt, Artificial Sequence; identical to SEQ ID NO: 181155
  derived and/or modified sequence opt4 from neuraminidase__InfluenzaB__AHL92050

SEQ ID NO: 182527 - RNA, 1401 nt, Artificial Sequence
  derived and/or modified sequence opt4 from neuraminidase__InfluenzaB__AHL92061
augcugcccagcaccacccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182528 - RNA, 1401 nt, Artificial Sequence
  derived and/or modified sequence opt4 from neuraminidase__InfluenzaB__AHL92072
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182529 - RNA, 1401 nt, Artificial Sequence; identical to SEQ ID NO: 182528
  derived and/or modified sequence opt4 from neuraminidase__InfluenzaB__AHL92083

SEQ ID NO: 182530 - RNA, 1401 nt, Artificial Sequence; identical to SEQ ID NO: 182528
  derived and/or modified sequence opt4 from neuraminidase__InfluenzaB__AHL92094

SEQ ID NO: 182531 - RNA, 1401 nt, Artificial Sequence
  derived and/or modified sequence opt4 from neuraminidase__InfluenzaB__AHL92105
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcggcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagccugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182532 - RNA, 1401 nt, Artificial Sequence; identical to SEQ ID NO: 181308
  derived and/or modified sequence opt4 from neuraminidase__InfluenzaB__AHL92116

SEQ ID NO: 182533 - RNA, 1401 nt, Artificial Sequence; identical to SEQ ID NO: 182528
  derived and/or modified sequence opt4 from neuraminidase__InfluenzaB__AHL92127

SEQ ID NO: 182534 - RNA, 1401 nt, Artificial Sequence; identical to SEQ ID NO: 182528
  derived and/or modified sequence opt4 from neuraminidase__InfluenzaB__AHL92138

SEQ ID NO: 182535 - RNA, 1401 nt, Artificial Sequence; identical to SEQ ID NO: 182528
  derived and/or modified sequence opt4 from neuraminidase__InfluenzaB__AHL92149

SEQ ID NO: 182536 - RNA, 1401 nt, Artificial Sequence
  derived and/or modified sequence opt4 from neuraminidase__InfluenzaB__AHL92171
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcuggugagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182537 - RNA, 1401 nt, Artificial Sequence
  derived and/or modified sequence opt4 from neuraminidase__InfluenzaB__AHL92182
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgagugggccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacagcggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182538 - RNA, 1401 nt, Artificial Sequence; identical to SEQ ID NO: 182537
  derived and/or modified sequence opt4 from neuraminidase__InfluenzaB__AHL92193

SEQ ID NO: 182539 - RNA, 1401 nt, Artificial Sequence; identical to SEQ ID NO: 181308
  derived and/or modified sequence opt4 from neuraminidase__InfluenzaB__AHL92204

SEQ ID NO: 182540 - RNA, 1401 nt, Artificial Sequence
  derived and/or modified sequence opt4 from neuraminidase__InfluenzaB__AHL92215
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaagggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182541 - RNA, 1401 nt, Artificial Sequence; identical to SEQ ID NO: 182528
  derived and/or modified sequence opt4 from neuraminidase__InfluenzaB__AHL92226

SEQ ID NO: 182542 - RNA, 1401 nt, Artificial Sequence; identical to SEQ ID NO: 181308
  derived and/or modified sequence opt4 from neuraminidase__InfluenzaB__AHL92237

SEQ ID NO: 182543 - RNA, 1401 nt, Artificial Sequence; identical to SEQ ID NO: 182528
  derived and/or modified sequence opt4 from neuraminidase__InfluenzaB__AHL92248

SEQ ID NO: 182544 - RNA, 1401 nt, Artificial Sequence
  derived and/or modified sequence opt4 from neuraminidase__InfluenzaB__AHL92259
augcugcccagcaccauccagacccugacccuguuccugaccagcggcggcgugcugcugagccuguacgugagcgccagccugagcuaccugcuguacagcgacauccugcugaaguucagccccaccgagaucaccgccagcaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaaugaccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182545 - RNA, 1401 nt, Artificial Sequence; identical to SEQ ID NO: 182528
  derived and/or modified sequence opt4 from neuraminidase__InfluenzaB__AHL92270

SEQ ID NO: 182546 - RNA, 1401 nt, Artificial Sequence
  derived and/or modified sequence opt4 from neuraminidase__InfluenzaB__AHL92281
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgccaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182547 - RNA, 1401 nt, Artificial Sequence
  derived and/or modified sequence opt4 from neuraminidase__InfluenzaB__AHL92303
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcaacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182548 - RNA, 1401 nt, Artificial Sequence
  derived and/or modified sequence opt4 from neuraminidase__InfluenzaB__AHL92314
augcugcccagcaccauccagacccugacccuguuccugaccagcggcggcgugcugcugagccuguacgugagcgccagccugagcuaccugcuguacagcgacauccugcugaaguucagccagaccaagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggacgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182549 - RNA, 1401 nt, Artificial Sequence
  derived and/or modified sequence opt4 from neuraminidase__InfluenzaB__AHL92325
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcaugggcgagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182550 - RNA, 1401 nt, Artificial Sequence; identical to SEQ ID NO: 181308
  derived and/or modified sequence opt4 from neuraminidase__InfluenzaB__AHL92336

SEQ ID NO: 182551 - RNA, 1401 nt, Artificial Sequence
  derived and/or modified sequence opt4 from neuraminidase__InfluenzaB__AHL92358
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacgugggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182552 - RNA, 1401 nt, Artificial Sequence; identical to SEQ ID NO: 182551
  derived and/or modified sequence opt4 from neuraminidase__InfluenzaB__AHL92369

SEQ ID NO: 182553 - RNA, 1401 nt, Artificial Sequence
  derived and/or modified sequence opt4 from neuraminidase__InfluenzaB__AHL92380
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaagcugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182554 - RNA, 1401 nt, Artificial Sequence
  derived and/or modified sequence opt4 from neuraminidase__InfluenzaB__AHL92391
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaagcaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182555 - RNA, 1401 nt, Artificial Sequence; identical to SEQ ID NO: 181337
  derived and/or modified sequence opt4 from neuraminidase__InfluenzaB__AHL92402

SEQ ID NO: 182556 - RNA, 1401 nt, Artificial Sequence; identical to SEQ ID NO: 181337
  derived and/or modified sequence opt4 from neuraminidase__InfluenzaB__AHL92413

SEQ ID NO: 182557 - RNA, 1401 nt, Artificial Sequence; identical to SEQ ID NO: 181337
  derived and/or modified sequence opt4 from neuraminidase__InfluenzaB__AHL92424

SEQ ID NO: 182558 - RNA, 1401 nt, Artificial Sequence
  derived and/or modified sequence opt4 from neuraminidase__InfluenzaB__AHL92435
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugaugaucagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182559 - RNA, 1401 nt, Artificial Sequence; identical to SEQ ID NO: 181337
  derived and/or modified sequence opt4 from neuraminidase__InfluenzaB__AHL92446

SEQ ID NO: 182560 - RNA, 1401 nt, Artificial Sequence; identical to SEQ ID NO: 181337
  derived and/or modified sequence opt4 from neuraminidase__InfluenzaB__AHL92457

SEQ ID NO: 182561 - RNA, 1401 nt, Artificial Sequence; identical to SEQ ID NO: 181337
  derived and/or modified sequence opt4 from neuraminidase__InfluenzaB__AHL92468

SEQ ID NO: 182562 - RNA, 1401 nt, Artificial Sequence; identical to SEQ ID NO: 181337
  derived and/or modified sequence opt4 from neuraminidase__InfluenzaB__AHL92479

SEQ ID NO: 182563 - RNA, 1401 nt, Artificial Sequence; identical to SEQ ID NO: 181308
  derived and/or modified sequence opt4 from neuraminidase__InfluenzaB__AHL92490

SEQ ID NO: 182564 - RNA, 1401 nt, Artificial Sequence; identical to SEQ ID NO: 181337
  derived and/or modified sequence opt4 from neuraminidase__InfluenzaB__AHL92501

SEQ ID NO: 182565 - RNA, 1401 nt, Artificial Sequence
  derived and/or modified sequence opt4 from neuraminidase__InfluenzaB__AHL92512
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacaugguggccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182566 - RNA, 1401 nt, Artificial Sequence; identical to SEQ ID NO: 181337
  derived and/or modified sequence opt4 from neuraminidase__InfluenzaB__AHL92523

SEQ ID NO: 182567 - RNA, 1401 nt, Artificial Sequence; identical to SEQ ID NO: 181337
  derived and/or modified sequence opt4 from neuraminidase__InfluenzaB__AHL92534

SEQ ID NO: 182568 - RNA, 1401 nt, Artificial Sequence; identical to SEQ ID NO: 181308
  derived and/or modified sequence opt4 from neuraminidase__InfluenzaB__AHL92545

SEQ ID NO: 182569 - RNA, 1401 nt, Artificial Sequence; identical to SEQ ID NO: 181337
  derived and/or modified sequence opt4 from neuraminidase__InfluenzaB__AHL92556

SEQ ID NO: 182570 - RNA, 1401 nt, Artificial Sequence; identical to SEQ ID NO: 181337
  derived and/or modified sequence opt4 from neuraminidase__InfluenzaB__AHL92567

SEQ ID NO: 182571 - RNA, 1401 nt, Artificial Sequence; identical to SEQ ID NO: 181337
  derived and/or modified sequence opt4 from neuraminidase__InfluenzaB__AHL92578

SEQ ID NO: 182572 - RNA, 1401 nt, Artificial Sequence; identical to SEQ ID NO: 181308
  derived and/or modified sequence opt4 from neuraminidase__InfluenzaB__AHL92589

SEQ ID NO: 182573 - RNA, 1401 nt, Artificial Sequence; identical to SEQ ID NO: 181337
  derived and/or modified sequence opt4 from neuraminidase__InfluenzaB__AHL92600

SEQ ID NO: 182574 - RNA, 1401 nt, Artificial Sequence; identical to SEQ ID NO: 182364
  derived and/or modified sequence opt4 from neuraminidase__InfluenzaB__AHL92611

SEQ ID NO: 182575 - RNA, 1401 nt, Artificial Sequence
  derived and/or modified sequence opt4 from neuraminidase__InfluenzaB__AHL92622
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182576 - RNA, 1401 nt, Artificial Sequence
  derived and/or modified sequence opt4 from neuraminidase__InfluenzaB__AHL92633
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaucguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182577 - RNA, 1401 nt, Artificial Sequence; identical to SEQ ID NO: 181308
  derived and/or modified sequence opt4 from neuraminidase__InfluenzaB__AHL92644

SEQ ID NO: 182578 - RNA, 1401 nt, Artificial Sequence; identical to SEQ ID NO: 181308
  derived and/or modified sequence opt4 from neuraminidase__InfluenzaB__AHL92655

SEQ ID NO: 182579 - RNA, 1401 nt, Artificial Sequence; identical to SEQ ID NO: 181337
  derived and/or modified sequence opt4 from neuraminidase__InfluenzaB__AHL92666

SEQ ID NO: 182580 - RNA, 1401 nt, Artificial Sequence; identical to SEQ ID NO: 181337
  derived and/or modified sequence opt4 from neuraminidase__InfluenzaB__AHL92677

SEQ ID NO: 182581 - RNA, 1401 nt, Artificial Sequence; identical to SEQ ID NO: 181308
  derived and/or modified sequence opt4 from neuraminidase__InfluenzaB__AHL92688

SEQ ID NO: 182582 - RNA, 1401 nt, Artificial Sequence; identical to SEQ ID NO: 181337
  derived and/or modified sequence opt4 from neuraminidase__InfluenzaB__AHL92699

SEQ ID NO: 182583 - RNA, 1401 nt, Artificial Sequence; identical to SEQ ID NO: 181337
  derived and/or modified sequence opt4 from neuraminidase__InfluenzaB__AHL92710

SEQ ID NO: 182584 - RNA, 1401 nt, Artificial Sequence; identical to SEQ ID NO: 181337
  derived and/or modified sequence opt4 from neuraminidase__InfluenzaB__AHL92721

SEQ ID NO: 182585 - RNA, 1401 nt, Artificial Sequence; identical to SEQ ID NO: 181337
  derived and/or modified sequence opt4 from neuraminidase__InfluenzaB__AHL92732

SEQ ID NO: 182586 - RNA, 1401 nt, Artificial Sequence; identical to SEQ ID NO: 181337
  derived and/or modified sequence opt4 from neuraminidase__InfluenzaB__AHL92743

SEQ ID NO: 182587 - RNA, 1401 nt, Artificial Sequence; identical to SEQ ID NO: 181337
  derived and/or modified sequence opt4 from neuraminidase__InfluenzaB__AHL92754

SEQ ID NO: 182588 - RNA, 1401 nt, Artificial Sequence; identical to SEQ ID NO: 181337
  derived and/or modified sequence opt4 from neuraminidase__InfluenzaB__AHL92765

SEQ ID NO: 182589 - RNA, 1401 nt, Artificial Sequence; identical to SEQ ID NO: 181337
  derived and/or modified sequence opt4 from neuraminidase__InfluenzaB__AHL92776

SEQ ID NO: 182590 - RNA, 1401 nt, Artificial Sequence; identical to SEQ ID NO: 181337
  derived and/or modified sequence opt4 from neuraminidase__InfluenzaB__AHL92787

SEQ ID NO: 182591 - RNA, 1401 nt, Artificial Sequence; identical to SEQ ID NO: 181337
  derived and/or modified sequence opt4 from neuraminidase__InfluenzaB__AHL92798

SEQ ID NO: 182592 - RNA, 1401 nt, Artificial Sequence
  derived and/or modified sequence opt4 from neuraminidase__InfluenzaB__AHL92809
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaucaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182593 - RNA, 1401 nt, Artificial Sequence
  derived and/or modified sequence opt4 from neuraminidase__InfluenzaB__AHL92820
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcgugaacaugacccuguga

SEQ ID NO: 182594 - RNA, 1401 nt, Artificial Sequence
  derived and/or modified sequence opt4 from neuraminidase__InfluenzaB__AHL92842
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcaccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182595 - RNA, 1401 nt, Artificial Sequence; identical to SEQ ID NO: 181337
  derived and/or modified sequence opt4 from neuraminidase__InfluenzaB__AHL92853

SEQ ID NO: 182596 - RNA, 1401 nt, Artificial Sequence; identical to SEQ ID NO: 181337
  derived and/or modified sequence opt4 from neuraminidase__InfluenzaB__AHL92864

SEQ ID NO: 182597 - RNA, 1401 nt, Artificial Sequence; identical to SEQ ID NO: 181190
  derived and/or modified sequence opt4 from neuraminidase__InfluenzaB__AHL92875

SEQ ID NO: 182598 - RNA, 1401 nt, Artificial Sequence; identical to SEQ ID NO: 181147
  derived and/or modified sequence opt4 from neuraminidase__InfluenzaB__AHL92886

SEQ ID NO: 182599 - RNA, 1401 nt, Artificial Sequence
  derived and/or modified sequence opt4 from neuraminidase__InfluenzaB__AHL92897
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaucccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182600 - RNA, 1401 nt, Artificial Sequence
  derived and/or modified sequence opt4 from neuraminidase__InfluenzaB__AHL92908
augcugcccagcaccauccagacccugacccuguuccugacccugggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccguguacugccugaugggcagcggccagcugcugugggacaccaucaccggcguggacauggcccuguga

SEQ ID NO: 182601 - RNA, 1401 nt, Artificial Sequence
  derived and/or modified sequence opt4 from neuraminidase__InfluenzaB__AHL92919
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcaucgacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182602 - RNA, 1401 nt, Artificial Sequence
  derived and/or modified sequence opt4 from neuraminidase__InfluenzaB__AHL92930
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcuggacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182603 - RNA, 1401 nt, Artificial Sequence; identical to SEQ ID NO: 181147
  derived and/or modified sequence opt4 from neuraminidase__InfluenzaB__AHL92941

SEQ ID NO: 182604 - RNA, 1401 nt, Artificial Sequence; identical to SEQ ID NO: 181155
  derived and/or modified sequence opt4 from neuraminidase__InfluenzaB__AHL92952

SEQ ID NO: 182605 - RNA, 1401 nt, Artificial Sequence; identical to SEQ ID NO: 181155
  derived and/or modified sequence opt4 from neuraminidase__InfluenzaB__AHL92963

SEQ ID NO: 182606 - RNA, 1401 nt, Artificial Sequence
  derived and/or modified sequence opt4 from neuraminidase__InfluenzaB__AHL92974
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacaacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182607 - RNA, 1401 nt, Artificial Sequence; identical to SEQ ID NO: 181155
  derived and/or modified sequence opt4 from neuraminidase__InfluenzaB__AHL92985

SEQ ID NO: 182608 - RNA, 1401 nt, Artificial Sequence; identical to SEQ ID NO: 181155
  derived and/or modified sequence opt4 from neuraminidase__InfluenzaB__AHL92996

SEQ ID NO: 182609 - RNA, 1401 nt, Artificial Sequence; identical to SEQ ID NO: 182528
  derived and/or modified sequence opt4 from neuraminidase__InfluenzaB__AHL93008

SEQ ID NO: 182610 - RNA, 1401 nt, Artificial Sequence; identical to SEQ ID NO: 182537
  derived and/or modified sequence opt4 from neuraminidase__InfluenzaB__AHL93019

SEQ ID NO: 182611 - RNA, 1401 nt, Artificial Sequence; identical to SEQ ID NO: 182537
  derived and/or modified sequence opt4 from neuraminidase__InfluenzaB__AHL93030

SEQ ID NO: 182612 - RNA, 1401 nt, Artificial Sequence; identical to SEQ ID NO: 182551
  derived and/or modified sequence opt4 from neuraminidase__InfluenzaB__AHL93041

SEQ ID NO: 182613 - RNA, 1401 nt, Artificial Sequence; identical to SEQ ID NO: 182551
  derived and/or modified sequence opt4 from neuraminidase__InfluenzaB__AHL93052

SEQ ID NO: 182614 - RNA, 1401 nt, Artificial Sequence; identical to SEQ ID NO: 181337
  derived and/or modified sequence opt4 from neuraminidase__InfluenzaB__AHL93063

SEQ ID NO: 182615 - RNA, 1401 nt, Artificial Sequence; identical to SEQ ID NO: 181337
  derived and/or modified sequence opt4 from neuraminidase__InfluenzaB__AHL93074

SEQ ID NO: 182616 - RNA, 1401 nt, Artificial Sequence; identical to SEQ ID NO: 181337
  derived and/or modified sequence opt4 from neuraminidase__InfluenzaB__AHL93085

SEQ ID NO: 182617 - RNA, 1401 nt, Artificial Sequence; identical to SEQ ID NO: 182594
  derived and/or modified sequence opt4 from neuraminidase__InfluenzaB__AHL93096

SEQ ID NO: 182618 - RNA, 1401 nt, Artificial Sequence; identical to SEQ ID NO: 181337
  derived and/or modified sequence opt4 from neuraminidase__InfluenzaB__AHL93107

SEQ ID NO: 182619 - RNA, 1401 nt, Artificial Sequence; identical to SEQ ID NO: 181337
  derived and/or modified sequence opt4 from neuraminidase__InfluenzaB__AHL93118

SEQ ID NO: 182620 - RNA, 1401 nt, Artificial Sequence; identical to SEQ ID NO: 181308
  derived and/or modified sequence opt4 from neuraminidase__InfluenzaB__AHL93129

SEQ ID NO: 182621 - RNA, 1401 nt, Artificial Sequence; identical to SEQ ID NO: 181337
  derived and/or modified sequence opt4 from neuraminidase__InfluenzaB__AHL93140

SEQ ID NO: 182622 - RNA, 1401 nt, Artificial Sequence; identical to SEQ ID NO: 181308
  derived and/or modified sequence opt4 from neuraminidase__InfluenzaB__AHL93151

SEQ ID NO: 182623 - RNA, 1401 nt, Artificial Sequence; identical to SEQ ID NO: 181337
  derived and/or modified sequence opt4 from neuraminidase__InfluenzaB__AHL93162

SEQ ID NO: 182624 - RNA, 1401 nt, Artificial Sequence; identical to SEQ ID NO: 181337
  derived and/or modified sequence opt4 from neuraminidase__InfluenzaB__AHL93173

SEQ ID NO: 182625 - RNA, 1401 nt, Artificial Sequence; identical to SEQ ID NO: 181308
  derived and/or modified sequence opt4 from neuraminidase__InfluenzaB__AHL93184

SEQ ID NO: 182626 - RNA, 1401 nt, Artificial Sequence; identical to SEQ ID NO: 181337
  derived and/or modified sequence opt4 from neuraminidase__InfluenzaB__AHL93195

SEQ ID NO: 182627 - RNA, 1401 nt, Artificial Sequence; identical to SEQ ID NO: 181337
  derived and/or modified sequence opt4 from neuraminidase__InfluenzaB__AHL93206

SEQ ID NO: 182628 - RNA, 1401 nt, Artificial Sequence; identical to SEQ ID NO: 181481
  derived and/or modified sequence opt4 from neuraminidase__InfluenzaB__AHL93217

SEQ ID NO: 182629 - RNA, 1401 nt, Artificial Sequence; identical to SEQ ID NO: 181481
  derived and/or modified sequence opt4 from neuraminidase__InfluenzaB__AHL93228

SEQ ID NO: 182630 - RNA, 1401 nt, Artificial Sequence
  derived and/or modified sequence opt4 from neuraminidase__InfluenzaB__AHL93239
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182631 - RNA, 1401 nt, Artificial Sequence
  derived and/or modified sequence opt4 from neuraminidase__InfluenzaB__AHL93250
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182632 - RNA, 1401 nt, Artificial Sequence; identical to SEQ ID NO: 181481
  derived and/or modified sequence opt4 from neuraminidase__InfluenzaB__AHL93261

SEQ ID NO: 182633 - RNA, 1401 nt, Artificial Sequence; identical to SEQ ID NO: 181481
  derived and/or modified sequence opt4 from neuraminidase__InfluenzaB__AHL93272

SEQ ID NO: 182634 - RNA, 1401 nt, Artificial Sequence; identical to SEQ ID NO: 181481
  derived and/or modified sequence opt4 from neuraminidase__InfluenzaB__AHL93283

SEQ ID NO: 182635 - RNA, 1401 nt, Artificial Sequence; identical to SEQ ID NO: 181481
  derived and/or modified sequence opt4 from neuraminidase__InfluenzaB__AHL93294

SEQ ID NO: 182636 - RNA, 1401 nt, Artificial Sequence
  derived and/or modified sequence opt4 from neuraminidase__InfluenzaB__AHL93305
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucguggccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182637 - RNA, 1401 nt, Artificial Sequence; identical to SEQ ID NO: 181481
  derived and/or modified sequence opt4 from neuraminidase__InfluenzaB__AHL93316

SEQ ID NO: 182638 - RNA, 1401 nt, Artificial Sequence
  derived and/or modified sequence opt4 from neuraminidase__InfluenzaB__AHL93338
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacgccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182639 - RNA, 1401 nt, Artificial Sequence
  derived and/or modified sequence opt4 from neuraminidase__InfluenzaB__AHL93349
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccagggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcauggagcuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 182640 - RNA, 1401 nt, Artificial Sequence; identical to SEQ ID NO: 181481
  derived and/or modified sequence opt4 from neuraminidase__InfluenzaB__AHL93371

SEQ ID NO: 182641 - RNA, 1401 nt, Artificial Sequence
  derived and/or modified sequence opt4 from neuraminidase__InfluenzaB__AHL93382
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcauggagcuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 182642 - RNA, 1401 nt, Artificial Sequence; identical to SEQ ID NO: 181481
  derived and/or modified sequence opt4 from neuraminidase__InfluenzaB__AHL93393

SEQ ID NO: 182643 - RNA, 1401 nt, Artificial Sequence; identical to SEQ ID NO: 181481
  derived and/or modified sequence opt4 from neuraminidase__InfluenzaB__AHL93404

SEQ ID NO: 182644 - RNA, 1401 nt, Artificial Sequence; identical to SEQ ID NO: 181481
  derived and/or modified sequence opt4 from neuraminidase__InfluenzaB__AHL93415

SEQ ID NO: 182645 - RNA, 1401 nt, Artificial Sequence; identical to SEQ ID NO: 181481
  derived and/or modified sequence opt4 from neuraminidase__InfluenzaB__AHL93426

SEQ ID NO: 182646 - RNA, 1401 nt, Artificial Sequence; identical to SEQ ID NO: 181481
  derived and/or modified sequence opt4 from neuraminidase__InfluenzaB__AHL93437

SEQ ID NO: 182647 - RNA, 1401 nt, Artificial Sequence; identical to SEQ ID NO: 182641
  derived and/or modified sequence opt4 from neuraminidase__InfluenzaB__AHL93448

SEQ ID NO: 182648 - RNA, 1404 nt, Artificial Sequence
  derived and/or modified sequence opt4 from neuraminidase__InfluenzaB__AHL93459
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182649 - RNA, 1401 nt, Artificial Sequence
  derived and/or modified sequence opt4 from neuraminidase__InfluenzaB__AHL93470
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182650 - RNA, 1401 nt, Artificial Sequence; identical to SEQ ID NO: 181418
  derived and/or modified sequence opt4 from neuraminidase__InfluenzaB__AHL93481

SEQ ID NO: 182651 - RNA, 1401 nt, Artificial Sequence; identical to SEQ ID NO: 181476
  derived and/or modified sequence opt4 from neuraminidase__InfluenzaB__AHL93492

SEQ ID NO: 182652 - RNA, 1401 nt, Artificial Sequence; identical to SEQ ID NO: 181337
  derived and/or modified sequence opt4 from neuraminidase__InfluenzaB__AHL93503

SEQ ID NO: 182653 - RNA, 1401 nt, Artificial Sequence
  derived and/or modified sequence opt4 from neuraminidase__InfluenzaB__AHL93514
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcaucaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggcagcugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182654 - RNA, 1401 nt, Artificial Sequence; identical to SEQ ID NO: 181337
  derived and/or modified sequence opt4 from neuraminidase__InfluenzaB__AHL93525

SEQ ID NO: 182655 - RNA, 1401 nt, Artificial Sequence; identical to SEQ ID NO: 181476
  derived and/or modified sequence opt4 from neuraminidase__InfluenzaB__AHL93536

SEQ ID NO: 182656 - RNA, 1401 nt, Artificial Sequence
  derived and/or modified sequence opt4 from neuraminidase__InfluenzaB__AHL93558
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucauccaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182657 - RNA, 1401 nt, Artificial Sequence
  derived and/or modified sequence opt4 from neuraminidase__InfluenzaB__AHL93569
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182658 - RNA, 1401 nt, Artificial Sequence; identical to SEQ ID NO: 181476
  derived and/or modified sequence opt4 from neuraminidase__InfluenzaB__AHL93580

SEQ ID NO: 182659 - RNA, 1401 nt, Artificial Sequence; identical to SEQ ID NO: 181476
  derived and/or modified sequence opt4 from neuraminidase__InfluenzaB__AHL93591

SEQ ID NO: 182660 - RNA, 1401 nt, Artificial Sequence
  derived and/or modified sequence opt4 from neuraminidase__InfluenzaB__AHL93613
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182661 - RNA, 1401 nt, Artificial Sequence; identical to SEQ ID NO: 181476
  derived and/or modified sequence opt4 from neuraminidase__InfluenzaB__AHL93624

SEQ ID NO: 182662 - RNA, 1401 nt, Artificial Sequence; identical to SEQ ID NO: 182660
  derived and/or modified sequence opt4 from neuraminidase__InfluenzaB__AHL93635

SEQ ID NO: 182663 - RNA, 1401 nt, Artificial Sequence; identical to SEQ ID NO: 182660
  derived and/or modified sequence opt4 from neuraminidase__InfluenzaB__AHL93646

SEQ ID NO: 182664 - RNA, 1401 nt, Artificial Sequence; identical to SEQ ID NO: 181337
  derived and/or modified sequence opt4 from neuraminidase__InfluenzaB__AHL93657

SEQ ID NO: 182665 - RNA, 1401 nt, Artificial Sequence; identical to SEQ ID NO: 181476
  derived and/or modified sequence opt4 from neuraminidase__InfluenzaB__AHL93668

SEQ ID NO: 182666 - RNA, 1401 nt, Artificial Sequence
  derived and/or modified sequence opt4 from neuraminidase__InfluenzaB__AHL93679
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagauccugcccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182667 - RNA, 1401 nt, Artificial Sequence; identical to SEQ ID NO: 182660
  derived and/or modified sequence opt4 from neuraminidase__InfluenzaB__AHL93690

SEQ ID NO: 182668 - RNA, 1401 nt, Artificial Sequence; identical to SEQ ID NO: 182660
  derived and/or modified sequence opt4 from neuraminidase__InfluenzaB__AHL93701

SEQ ID NO: 182669 - RNA, 1401 nt, Artificial Sequence; identical to SEQ ID NO: 182660
  derived and/or modified sequence opt4 from neuraminidase__InfluenzaB__AHL93712

SEQ ID NO: 182670 - RNA, 1401 nt, Artificial Sequence
  derived and/or modified sequence opt4 from neuraminidase__InfluenzaB__AHL93723
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaccaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182671 - RNA, 1401 nt, Artificial Sequence; identical to SEQ ID NO: 181476
  derived and/or modified sequence opt4 from neuraminidase__InfluenzaB__AHL93734

SEQ ID NO: 182672 - RNA, 1401 nt, Artificial Sequence
  derived and/or modified sequence opt4 from neuraminidase__InfluenzaB__AHL93745
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacgugcugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182673 - RNA, 1401 nt, Artificial Sequence; identical to SEQ ID NO: 181639
  derived and/or modified sequence opt4 from neuraminidase__InfluenzaB__AHL93756

SEQ ID NO: 182674 - RNA, 1401 nt, Artificial Sequence; identical to SEQ ID NO: 182660
  derived and/or modified sequence opt4 from neuraminidase__InfluenzaB__AHL93767

SEQ ID NO: 182675 - RNA, 1401 nt, Artificial Sequence
  derived and/or modified sequence opt4 from neuraminidase__InfluenzaB__AHL93778
augcugcccagcaccauccagacccugauccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaucuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182676 - RNA, 1401 nt, Artificial Sequence
  derived and/or modified sequence opt4 from neuraminidase__InfluenzaB__AHL93789
augcugcccagcaccauccagacccugacccuguuccugaccagcggcggcgugcugcugagccuguacgugagcgccagccugagcuaccugcuguacagcgacauccugcugaaguucagccccaccggcaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182677 - RNA, 1401 nt, Artificial Sequence; identical to SEQ ID NO: 181476
  derived and/or modified sequence opt4 from neuraminidase__InfluenzaB__AHL93800

SEQ ID NO: 182678 - RNA, 1401 nt, Artificial Sequence; identical to SEQ ID NO: 181476
  derived and/or modified sequence opt4 from neuraminidase__InfluenzaB__AHL93811

SEQ ID NO: 182679 - RNA, 1401 nt, Artificial Sequence; identical to SEQ ID NO: 182012
  derived and/or modified sequence opt4 from neuraminidase__InfluenzaB__AHL93822

SEQ ID NO: 182680 - RNA, 1401 nt, Artificial Sequence; identical to SEQ ID NO: 181476
  derived and/or modified sequence opt4 from neuraminidase__InfluenzaB__AHL93833

SEQ ID NO: 182681 - RNA, 1401 nt, Artificial Sequence
  derived and/or modified sequence opt4 from neuraminidase__InfluenzaB__AHL93844
augcugcccagcaccauccagacccugacccuguuccugaccagcggcggcgugcugcugagccuguacgugagcgccagccugagcuaccugcuguacagcggcauccugcugaaguucagccccaccgagaucaccgcccccaccaugccccuggacugcgccaacgccagcaacgugcaggccgugaacagaagcgccaccaaggaggugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacgacaacgcccugcugaaggugaaguacggcgaggccuacaccgacaccuaccacagcuacgcccacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182682 - RNA, 1401 nt, Artificial Sequence; identical to SEQ ID NO: 181476
  derived and/or modified sequence opt4 from neuraminidase__InfluenzaB__AHL93855

SEQ ID NO: 182683 - RNA, 1401 nt, Artificial Sequence; identical to SEQ ID NO: 181476
  derived and/or modified sequence opt4 from neuraminidase__InfluenzaB__AHL93866

SEQ ID NO: 182684 - RNA, 1401 nt, Artificial Sequence; identical to SEQ ID NO: 181476
  derived and/or modified sequence opt4 from neuraminidase__InfluenzaB__AHL93877

SEQ ID NO: 182685 - RNA, 1401 nt, Artificial Sequence; identical to SEQ ID NO: 181476
  derived and/or modified sequence opt4 from neuraminidase__InfluenzaB__AHL93888

SEQ ID NO: 182686 - RNA, 1401 nt, Artificial Sequence
  derived and/or modified sequence opt4 from neuraminidase__InfluenzaB__AHL93899
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcgagcccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaccaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182687 - RNA, 1401 nt, Artificial Sequence
  derived and/or modified sequence opt4 from neuraminidase__InfluenzaB__AHL93910
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcaccugcagagacaacagcuacaccgccaagagacccuucgugaagcugaacguggagaccgacaccgccgagaucagacugaugugcaccgacaccuaccuggacacccccagacccgacgacggcggcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182688 - RNA, 1401 nt, Artificial Sequence; identical to SEQ ID NO: 181476
  derived and/or modified sequence opt4 from neuraminidase__InfluenzaB__AHL93921

SEQ ID NO: 182689 - RNA, 1401 nt, Artificial Sequence
  derived and/or modified sequence opt4 from neuraminidase__InfluenzaB__AHL93932
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcauggagcuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182690 - RNA, 1401 nt, Artificial Sequence; identical to SEQ ID NO: 181639
  derived and/or modified sequence opt4 from neuraminidase__InfluenzaB__AHL93943

SEQ ID NO: 182691 - RNA, 1401 nt, Artificial Sequence; identical to SEQ ID NO: 181476
  derived and/or modified sequence opt4 from neuraminidase__InfluenzaB__AHL93954

SEQ ID NO: 182692 - RNA, 1401 nt, Artificial Sequence
  derived and/or modified sequence opt4 from neuraminidase__InfluenzaB__AHL93965
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacugcagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcaacggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182693 - RNA, 1401 nt, Artificial Sequence; identical to SEQ ID NO: 181395
  derived and/or modified sequence opt4 from neuraminidase__InfluenzaB__AHL93976

SEQ ID NO: 182694 - RNA, 1401 nt, Artificial Sequence; identical to SEQ ID NO: 182666
  derived and/or modified sequence opt4 from neuraminidase__InfluenzaB__AHL93987

SEQ ID NO: 182695 - RNA, 1401 nt, Artificial Sequence
  derived and/or modified sequence opt4 from neuraminidase__InfluenzaB__AHL93998
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182696 - RNA, 1401 nt, Artificial Sequence
  derived and/or modified sequence opt4 from neuraminidase__InfluenzaB__AHL94009
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccaaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcagacacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182697 - RNA, 1401 nt, Artificial Sequence; identical to SEQ ID NO: 181476
  derived and/or modified sequence opt4 from neuraminidase__InfluenzaB__AHL94020

SEQ ID NO: 182698 - RNA, 1401 nt, Artificial Sequence; identical to SEQ ID NO: 181476
  derived and/or modified sequence opt4 from neuraminidase__InfluenzaB__AHL94031

SEQ ID NO: 182699 - RNA, 1401 nt, Artificial Sequence; identical to SEQ ID NO: 181639
  derived and/or modified sequence opt4 from neuraminidase__InfluenzaB__AHL94042

SEQ ID NO: 182700 - RNA, 1401 nt, Artificial Sequence
  derived and/or modified sequence opt4 from neuraminidase__InfluenzaB__AHL94053
augcugcccagcaccauccagacccugacccuguuccugaccagcggcggcgugcugcugagccuguaccugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagagagcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182701 - RNA, 1401 nt, Artificial Sequence; identical to SEQ ID NO: 181476
  derived and/or modified sequence opt4 from neuraminidase__InfluenzaB__AHL94064

SEQ ID NO: 182702 - RNA, 1401 nt, Artificial Sequence; identical to SEQ ID NO: 181476
  derived and/or modified sequence opt4 from neuraminidase__InfluenzaB__AHL94075

SEQ ID NO: 182703 - RNA, 1401 nt, Artificial Sequence
  derived and/or modified sequence opt4 from neuraminidase__InfluenzaB__AHL94086
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucguggccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182704 - RNA, 1401 nt, Artificial Sequence; identical to SEQ ID NO: 181639
  derived and/or modified sequence opt4 from neuraminidase__InfluenzaB__AHL94095

SEQ ID NO: 182705 - RNA, 1401 nt, Artificial Sequence; identical to SEQ ID NO: 181476
  derived and/or modified sequence opt4 from neuraminidase__InfluenzaB__AHL94106

SEQ ID NO: 182706 - RNA, 1401 nt, Artificial Sequence
  derived and/or modified sequence opt4 from neuraminidase__InfluenzaB__AHL94117
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccugcacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 182707 - RNA, 1401 nt, Artificial Sequence; identical to SEQ ID NO: 181476
  derived and/or modified sequence opt4 from neuraminidase__InfluenzaB__AHL94128

SEQ ID NO: 182708 - RNA, 1401 nt, Artificial Sequence
  derived and/or modified sequence opt4 from neuraminidase__InfluenzaB__AHL94139
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcccgagcccgaguggaccuaccccagacugagcugccccggcagcaccuuccagagagcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucaagcugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182709 - RNA, 1401 nt, Artificial Sequence; identical to SEQ ID NO: 182666
  derived and/or modified sequence opt4 from neuraminidase__InfluenzaB__AHL94150

SEQ ID NO: 182710 - RNA, 1401 nt, Artificial Sequence
  derived and/or modified sequence opt4 from neuraminidase__InfluenzaB__AHL94161
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccaagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182711 - RNA, 1401 nt, Artificial Sequence; identical to SEQ ID NO: 182666
  derived and/or modified sequence opt4 from neuraminidase__InfluenzaB__AHL94183

SEQ ID NO: 182712 - RNA, 1404 nt, Artificial Sequence
  derived and/or modified sequence opt4 from neuraminidase__InfluenzaB__AHL94194
augcugcccagcaccauccagacccugacccuguuccugaccagcggcggcgugcugcugagccuguacgugagcgcccugcugagcuaccugcuguacagcgacauccugcugaaguucagccccaccgagaucaccgcccccaccaugagccuggacugcgccaacgccagcaacgugcaggccgugaacagaagcgccaccaagggcgugaccuuccugcugcugcccgagcccgaguggaccuaccccagacugagcugccccggcagcaccuuccagagagcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacgacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182713 - RNA, 1401 nt, Artificial Sequence; identical to SEQ ID NO: 181476
  derived and/or modified sequence opt4 from neuraminidase__InfluenzaB__AHL94205

SEQ ID NO: 182714 - RNA, 1401 nt, Artificial Sequence; identical to SEQ ID NO: 181639
  derived and/or modified sequence opt4 from neuraminidase__InfluenzaB__AHL94214

SEQ ID NO: 182715 - RNA, 1401 nt, Artificial Sequence
  derived and/or modified sequence opt4 from neuraminidase__InfluenzaB__AHL94224
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaucgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182716 - RNA, 1401 nt, Artificial Sequence; identical to SEQ ID NO: 181476
  derived and/or modified sequence opt4 from neuraminidase__InfluenzaB__AHL94235

SEQ ID NO: 182717 - RNA, 1401 nt, Artificial Sequence; identical to SEQ ID NO: 181639
  derived and/or modified sequence opt4 from neuraminidase__InfluenzaB__AHL94246

SEQ ID NO: 182718 - RNA, 1401 nt, Artificial Sequence; identical to SEQ ID NO: 181639
  derived and/or modified sequence opt4 from neuraminidase__InfluenzaB__AHL94257

SEQ ID NO: 182719 - RNA, 1401 nt, Artificial Sequence; identical to SEQ ID NO: 181337
  derived and/or modified sequence opt4 from neuraminidase__InfluenzaB__AHL94267

SEQ ID NO: 182720 - RNA, 1401 nt, Artificial Sequence; identical to SEQ ID NO: 181337
  derived and/or modified sequence opt4 from neuraminidase__InfluenzaB__AHL94278

SEQ ID NO: 182721 - RNA, 1401 nt, Artificial Sequence; identical to SEQ ID NO: 181337
  derived and/or modified sequence opt4 from neuraminidase__InfluenzaB__AHL94299

SEQ ID NO: 182722 - RNA, 1401 nt, Artificial Sequence
  derived and/or modified sequence opt4 from neuraminidase__InfluenzaB__AHL94310
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucgccggccccugcgagagcaacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182723 - RNA, 1401 nt, Artificial Sequence; identical to SEQ ID NO: 182722
  derived and/or modified sequence opt4 from neuraminidase__InfluenzaB__AHL94321

SEQ ID NO: 182724 - RNA, 1401 nt, Artificial Sequence
  derived and/or modified sequence opt4 from neuraminidase__InfluenzaB__AHL94332
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182725 - RNA, 1401 nt, Artificial Sequence; identical to SEQ ID NO: 181337
  derived and/or modified sequence opt4 from neuraminidase__InfluenzaB__AHL94343

SEQ ID NO: 182726 - RNA, 1401 nt, Artificial Sequence
  derived and/or modified sequence opt4 from neuraminidase__InfluenzaB__AHL94354
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182727 - RNA, 1401 nt, Artificial Sequence; identical to SEQ ID NO: 182726
  derived and/or modified sequence opt4 from neuraminidase__InfluenzaB__AHL94365

SEQ ID NO: 182728 - RNA, 1401 nt, Artificial Sequence
  derived and/or modified sequence opt4 from neuraminidase__InfluenzaB__AHL94387
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaccgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuaccugggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaucuggcacagcgccgccaccgccaucuacugccugaugggcagcggccagcugcugugggacaccgugaccggcguggacauggcccuguga

SEQ ID NO: 182729 - RNA, 1404 nt, Artificial Sequence
  derived and/or modified sequence opt4 from neuraminidase__InfluenzaB__AHL94398
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182730 - RNA, 1401 nt, Artificial Sequence; identical to SEQ ID NO: 182726
  derived and/or modified sequence opt4 from neuraminidase__InfluenzaB__AHL94409

SEQ ID NO: 182731 - RNA, 1401 nt, Artificial Sequence
  derived and/or modified sequence opt4 from neuraminidase__InfluenzaB__AHL94431
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaaccacagcgccgccaagggcgugacccugauccugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugaugaucagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182732 - RNA, 1401 nt, Artificial Sequence
  derived and/or modified sequence opt4 from neuraminidase__InfluenzaB__AHL94442
augcugcccagcaccauccagacccugacccuguuccugaccagcggcggcgugcugcugagccuguacaugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucgccggccccugcgagagcaacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182733 - RNA, 1401 nt, Artificial Sequence; identical to SEQ ID NO: 182722
  derived and/or modified sequence opt4 from neuraminidase__InfluenzaB__AHL94464

SEQ ID NO: 182734 - RNA, 1401 nt, Artificial Sequence; identical to SEQ ID NO: 181337
  derived and/or modified sequence opt4 from neuraminidase__InfluenzaB__AHL94475

SEQ ID NO: 182735 - RNA, 1401 nt, Artificial Sequence; identical to SEQ ID NO: 182726
  derived and/or modified sequence opt4 from neuraminidase__InfluenzaB__AHL94486

SEQ ID NO: 182736 - RNA, 1401 nt, Artificial Sequence; identical to SEQ ID NO: 181337
  derived and/or modified sequence opt4 from neuraminidase__InfluenzaB__AHL94497

SEQ ID NO: 182737 - RNA, 1401 nt, Artificial Sequence; identical to SEQ ID NO: 182722
  derived and/or modified sequence opt4 from neuraminidase__InfluenzaB__AHL94508

SEQ ID NO: 182738 - RNA, 1401 nt, Artificial Sequence
  derived and/or modified sequence opt4 from neuraminidase__InfluenzaB__AHL94519
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccuggaccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182739 - RNA, 1401 nt, Artificial Sequence; identical to SEQ ID NO: 182722
  derived and/or modified sequence opt4 from neuraminidase__InfluenzaB__AHL94530

SEQ ID NO: 182740 - RNA, 1401 nt, Artificial Sequence; identical to SEQ ID NO: 182726
  derived and/or modified sequence opt4 from neuraminidase__InfluenzaB__AHL94541

SEQ ID NO: 182741 - RNA, 1401 nt, Artificial Sequence
  derived and/or modified sequence opt4 from neuraminidase__InfluenzaB__AHL94563
augcugcccagcaccauccagacccugacccuguuccugacccugggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182742 - RNA, 1401 nt, Artificial Sequence; identical to SEQ ID NO: 182695
  derived and/or modified sequence opt4 from neuraminidase__InfluenzaB__AHL94574

SEQ ID NO: 182743 - RNA, 1401 nt, Artificial Sequence
  derived and/or modified sequence opt4 from neuraminidase__InfluenzaB__AHL94585
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaagggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182744 - RNA, 1401 nt, Artificial Sequence; identical to SEQ ID NO: 182695
  derived and/or modified sequence opt4 from neuraminidase__InfluenzaB__AHL94596

SEQ ID NO: 182745 - RNA, 1401 nt, Artificial Sequence
  derived and/or modified sequence opt4 from neuraminidase__InfluenzaB__AHL94607
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagacugaagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182746 - RNA, 1401 nt, Artificial Sequence; identical to SEQ ID NO: 182726
  derived and/or modified sequence opt4 from neuraminidase__InfluenzaB__AHL94618

SEQ ID NO: 182747 - RNA, 1401 nt, Artificial Sequence; identical to SEQ ID NO: 182722
  derived and/or modified sequence opt4 from neuraminidase__InfluenzaB__AHL94628

SEQ ID NO: 182748 - RNA, 1401 nt, Artificial Sequence; identical to SEQ ID NO: 182726
  derived and/or modified sequence opt4 from neuraminidase__InfluenzaB__AHL94639

SEQ ID NO: 182749 - RNA, 1401 nt, Artificial Sequence
  derived and/or modified sequence opt4 from neuraminidase__InfluenzaB__AHL94650
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucagagagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182750 - RNA, 1401 nt, Artificial Sequence
  derived and/or modified sequence opt4 from neuraminidase__InfluenzaB__AHL94661
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaauccagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgaggacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacaacggcgaccccugggccgacagcgacgcccugguguucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacaugacccuguga

SEQ ID NO: 182751 - RNA, 1401 nt, Artificial Sequence
  derived and/or modified sequence opt4 from neuraminidase__InfluenzaB__AHL94672
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucagcggccccugcgagagcaacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182752 - RNA, 1401 nt, Artificial Sequence
  derived and/or modified sequence opt4 from neuraminidase__InfluenzaB__AHL94683
augcugcccagcaccauccagacccugacccuguuccugaccagcggcggcgugcugcugagccuguacgugagcgccagccugagcuaccugcuguacagcgacauccugcugaaguucagcagaaccgagaucaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcggcgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182753 - RNA, 1401 nt, Artificial Sequence
  derived and/or modified sequence opt4 from neuraminidase__InfluenzaB__AHL94694
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182754 - RNA, 1401 nt, Artificial Sequence; identical to SEQ ID NO: 182726
  derived and/or modified sequence opt4 from neuraminidase__InfluenzaB__AHL94705

SEQ ID NO: 182755 - RNA, 1401 nt, Artificial Sequence; identical to SEQ ID NO: 181337
  derived and/or modified sequence opt4 from neuraminidase__InfluenzaB__AHL94716

SEQ ID NO: 182756 - RNA, 1401 nt, Artificial Sequence
  derived and/or modified sequence opt4 from neuraminidase__InfluenzaB__AHL94727
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacaccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaauccagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgaggacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacaacggcgaccccugggccgacagcgacgcccugguguucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacaugacccuguga

SEQ ID NO: 182757 - RNA, 1401 nt, Artificial Sequence; identical to SEQ ID NO: 181337
  derived and/or modified sequence opt4 from neuraminidase__InfluenzaB__AHL94738

SEQ ID NO: 182758 - RNA, 1401 nt, Artificial Sequence
  derived and/or modified sequence opt4 from neuraminidase__InfluenzaB__AHL94749
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcguggagauggugcacgacggcggcaaggagaccuggcacagcgccgccaccgccaucuacugccugaugggcagcggccagcugcugugggacaccgugaccggcguggacauggcccuguga

SEQ ID NO: 182759 - RNA, 1401 nt, Artificial Sequence
  derived and/or modified sequence opt4 from neuraminidase__InfluenzaB__AHL94760
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacauccccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182760 - RNA, 1401 nt, Artificial Sequence; identical to SEQ ID NO: 182726
  derived and/or modified sequence opt4 from neuraminidase__InfluenzaB__AHL94770

SEQ ID NO: 182761 - RNA, 1401 nt, Artificial Sequence; identical to SEQ ID NO: 182724
  derived and/or modified sequence opt4 from neuraminidase__InfluenzaB__AHL94781

SEQ ID NO: 182762 - RNA, 1401 nt, Artificial Sequence; identical to SEQ ID NO: 182722
  derived and/or modified sequence opt4 from neuraminidase__InfluenzaB__AHL94791

SEQ ID NO: 182763 - RNA, 1401 nt, Artificial Sequence; identical to SEQ ID NO: 182753
  derived and/or modified sequence opt4 from neuraminidase__InfluenzaB__AHL94801

SEQ ID NO: 182764 - RNA, 1401 nt, Artificial Sequence; identical to SEQ ID NO: 182722
  derived and/or modified sequence opt4 from neuraminidase__InfluenzaB__AHL94812

SEQ ID NO: 182765 - RNA, 1401 nt, Artificial Sequence; identical to SEQ ID NO: 182722
  derived and/or modified sequence opt4 from neuraminidase__InfluenzaB__AHL94821

SEQ ID NO: 182766 - RNA, 1401 nt, Artificial Sequence; identical to SEQ ID NO: 182726
  derived and/or modified sequence opt4 from neuraminidase__InfluenzaB__AHL94831

SEQ ID NO: 182767 - RNA, 1401 nt, Artificial Sequence
  derived and/or modified sequence opt4 from neuraminidase__InfluenzaB__AHL94840
augcugcccagcaccauccagacccugacccuguuccugaccagcggcggcgugcugcugagccuguacgugagcgccagccugagcuaccugcuguacagcggcauccugcugaaguucagcagaaccgagaucaccgcccccaucaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182768 - RNA, 1401 nt, Artificial Sequence
  derived and/or modified sequence opt4 from neuraminidase__InfluenzaB__AHL94851
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcaccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaaugaccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182769 - RNA, 1401 nt, Artificial Sequence; identical to SEQ ID NO: 181155
  derived and/or modified sequence opt4 from neuraminidase__InfluenzaB__AHL94862

SEQ ID NO: 182770 - RNA, 1401 nt, Artificial Sequence; identical to SEQ ID NO: 181337
  derived and/or modified sequence opt4 from neuraminidase__InfluenzaB__AHL94873

SEQ ID NO: 182771 - RNA, 1401 nt, Artificial Sequence; identical to SEQ ID NO: 182641
  derived and/or modified sequence opt4 from neuraminidase__InfluenzaB__AHL94884

SEQ ID NO: 182772 - RNA, 1401 nt, Artificial Sequence; identical to SEQ ID NO: 181481
  derived and/or modified sequence opt4 from neuraminidase__InfluenzaB__AHL94893

SEQ ID NO: 182773 - RNA, 1401 nt, Artificial Sequence; identical to SEQ ID NO: 181481
  derived and/or modified sequence opt4 from neuraminidase__InfluenzaB__AHL94904

SEQ ID NO: 182774 - RNA, 1401 nt, Artificial Sequence
  derived and/or modified sequence opt4 from neuraminidase__InfluenzaB__AHL94915
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcagguggugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182775 - RNA, 1401 nt, Artificial Sequence; identical to SEQ ID NO: 182641
  derived and/or modified sequence opt4 from neuraminidase__InfluenzaB__AHL94926

SEQ ID NO: 182776 - RNA, 1401 nt, Artificial Sequence
  derived and/or modified sequence opt4 from neuraminidase__InfluenzaB__AHL94937
augcugcccagcaccauccagacccugacccuguuccugaccagcggcggcgugcugcugagccuguacgugagcgccagccugagcuaccugcuguacagcgacauccugcugaaguucagccccaccgagaucaccgcccccacccugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182777 - RNA, 1401 nt, Artificial Sequence; identical to SEQ ID NO: 182660
  derived and/or modified sequence opt4 from neuraminidase__InfluenzaB__AHL94948

SEQ ID NO: 182778 - RNA, 1401 nt, Artificial Sequence; identical to SEQ ID NO: 181476
  derived and/or modified sequence opt4 from neuraminidase__InfluenzaB__AHL94959

SEQ ID NO: 182779 - RNA, 1401 nt, Artificial Sequence; identical to SEQ ID NO: 181476
  derived and/or modified sequence opt4 from neuraminidase__InfluenzaB__AHL94969

SEQ ID NO: 182780 - RNA, 1401 nt, Artificial Sequence; identical to SEQ ID NO: 181476
  derived and/or modified sequence opt4 from neuraminidase__InfluenzaB__AHL94978

SEQ ID NO: 182781 - RNA, 1401 nt, Artificial Sequence
  derived and/or modified sequence opt4 from neuraminidase__InfluenzaB__AHM00990
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcaccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182782 - RNA, 1401 nt, Artificial Sequence; identical to SEQ ID NO: 182726
  derived and/or modified sequence opt4 from neuraminidase__InfluenzaB__AHM01001

SEQ ID NO: 182783 - RNA, 1401 nt, Artificial Sequence
  derived and/or modified sequence opt4 from neuraminidase__InfluenzaB__AHM01012
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccuggaccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182784 - RNA, 1401 nt, Artificial Sequence; identical to SEQ ID NO: 182726
  derived and/or modified sequence opt4 from neuraminidase__InfluenzaB__AHM01023

SEQ ID NO: 182785 - RNA, 1401 nt, Artificial Sequence; identical to SEQ ID NO: 182726
  derived and/or modified sequence opt4 from neuraminidase__InfluenzaB__AHM01034

SEQ ID NO: 182786 - RNA, 1401 nt, Artificial Sequence
  derived and/or modified sequence opt4 from neuraminidase__InfluenzaB__AHM01045
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccggcuggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccguggccggcguggacauggcccuguga

SEQ ID NO: 182787 - RNA, 1401 nt, Artificial Sequence
  derived and/or modified sequence opt4 from neuraminidase__InfluenzaB__AHM01056
augcugcccagcaccacccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182788 - RNA, 1401 nt, Artificial Sequence; identical to SEQ ID NO: 182726
  derived and/or modified sequence opt4 from neuraminidase__InfluenzaB__AHM01067

SEQ ID NO: 182789 - RNA, 1401 nt, Artificial Sequence; identical to SEQ ID NO: 182695
  derived and/or modified sequence opt4 from neuraminidase__InfluenzaB__AHM01078

SEQ ID NO: 182790 - RNA, 1401 nt, Artificial Sequence
  derived and/or modified sequence opt4 from neuraminidase__InfluenzaB__AHM01089
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182791 - RNA, 1401 nt, Artificial Sequence; identical to SEQ ID NO: 182695
  derived and/or modified sequence opt4 from neuraminidase__InfluenzaB__AHM01100

SEQ ID NO: 182792 - RNA, 1401 nt, Artificial Sequence; identical to SEQ ID NO: 182726
  derived and/or modified sequence opt4 from neuraminidase__InfluenzaB__AHM01111

SEQ ID NO: 182793 - RNA, 1401 nt, Artificial Sequence
  derived and/or modified sequence opt4 from neuraminidase__InfluenzaB__AHM01122
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaagcugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182794 - RNA, 1401 nt, Artificial Sequence; identical to SEQ ID NO: 182726
  derived and/or modified sequence opt4 from neuraminidase__InfluenzaB__AHM01133

SEQ ID NO: 182795 - RNA, 1401 nt, Artificial Sequence
  derived and/or modified sequence opt4 from neuraminidase__InfluenzaB__AHM01144
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182796 - RNA, 1401 nt, Artificial Sequence; identical to SEQ ID NO: 182726
  derived and/or modified sequence opt4 from neuraminidase__InfluenzaB__AHM01166

SEQ ID NO: 182797 - RNA, 1401 nt, Artificial Sequence
  derived and/or modified sequence opt4 from neuraminidase__InfluenzaB__AHM01188
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182798 - RNA, 1401 nt, Artificial Sequence; identical to SEQ ID NO: 182790
  derived and/or modified sequence opt4 from neuraminidase__InfluenzaB__AHM01199

SEQ ID NO: 182799 - RNA, 1401 nt, Artificial Sequence
  derived and/or modified sequence opt4 from neuraminidase__InfluenzaB__AHM01210
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccggcuggaccuaccccagacugagcugccccggcagcaccuuccagaaggcccugcugaucagcccccacagauucggcgaggccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccguggccggcguggacauggcccuguga

SEQ ID NO: 182800 - RNA, 1401 nt, Artificial Sequence
  derived and/or modified sequence opt4 from neuraminidase__InfluenzaB__AHM01221
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacuuccaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182801 - RNA, 1401 nt, Artificial Sequence; identical to SEQ ID NO: 182695
  derived and/or modified sequence opt4 from neuraminidase__InfluenzaB__AHM01232

SEQ ID NO: 182802 - RNA, 1401 nt, Artificial Sequence; identical to SEQ ID NO: 182726
  derived and/or modified sequence opt4 from neuraminidase__InfluenzaB__AHM01243

SEQ ID NO: 182803 - RNA, 1401 nt, Artificial Sequence
  derived and/or modified sequence opt4 from neuraminidase__InfluenzaB__AHM01254
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182804 - RNA, 1401 nt, Artificial Sequence
  derived and/or modified sequence opt4 from neuraminidase__InfluenzaB__AHM01265
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacgagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggcagacugcugugggacaccgugaccggcguggacauggcccuguga

SEQ ID NO: 182805 - RNA, 1401 nt, Artificial Sequence
  derived and/or modified sequence opt4 from neuraminidase__InfluenzaB__AHM01276
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcaccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182806 - RNA, 1401 nt, Artificial Sequence; identical to SEQ ID NO: 182790
  derived and/or modified sequence opt4 from neuraminidase__InfluenzaB__AHM01287

SEQ ID NO: 182807 - RNA, 1401 nt, Artificial Sequence; identical to SEQ ID NO: 182790
  derived and/or modified sequence opt4 from neuraminidase__InfluenzaB__AHM01298

SEQ ID NO: 182808 - RNA, 1401 nt, Artificial Sequence; identical to SEQ ID NO: 182805
  derived and/or modified sequence opt4 from neuraminidase__InfluenzaB__AHM01309

SEQ ID NO: 182809 - RNA, 1401 nt, Artificial Sequence; identical to SEQ ID NO: 182726
  derived and/or modified sequence opt4 from neuraminidase__InfluenzaB__AHM01320

SEQ ID NO: 182810 - RNA, 1401 nt, Artificial Sequence; identical to SEQ ID NO: 182790
  derived and/or modified sequence opt4 from neuraminidase__InfluenzaB__AHM01331

SEQ ID NO: 182811 - RNA, 1401 nt, Artificial Sequence; identical to SEQ ID NO: 182726
  derived and/or modified sequence opt4 from neuraminidase__InfluenzaB__AHM01342

SEQ ID NO: 182812 - RNA, 1401 nt, Artificial Sequence
  derived and/or modified sequence opt4 from neuraminidase__InfluenzaB__AHM01353
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccggcuggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182813 - RNA, 1401 nt, Artificial Sequence
  derived and/or modified sequence opt4 from neuraminidase__InfluenzaB__AHM01364
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacgagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182814 - RNA, 1401 nt, Artificial Sequence; identical to SEQ ID NO: 182805
  derived and/or modified sequence opt4 from neuraminidase__InfluenzaB__AHM01375

SEQ ID NO: 182815 - RNA, 1401 nt, Artificial Sequence; identical to SEQ ID NO: 182805
  derived and/or modified sequence opt4 from neuraminidase__InfluenzaB__AHM01386

SEQ ID NO: 182816 - RNA, 1401 nt, Artificial Sequence; identical to SEQ ID NO: 182726
  derived and/or modified sequence opt4 from neuraminidase__InfluenzaB__AHM01397

SEQ ID NO: 182817 - RNA, 1401 nt, Artificial Sequence; identical to SEQ ID NO: 182726
  derived and/or modified sequence opt4 from neuraminidase__InfluenzaB__AHM01408

SEQ ID NO: 182818 - RNA, 1401 nt, Artificial Sequence; identical to SEQ ID NO: 182726
  derived and/or modified sequence opt4 from neuraminidase__InfluenzaB__AHM01419

SEQ ID NO: 182819 - RNA, 1401 nt, Artificial Sequence
  derived and/or modified sequence opt4 from neuraminidase__InfluenzaB__AHM01430
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacgagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggcagacugcugugggacaccgccaccggcguggacauggcccuguga

SEQ ID NO: 182820 - RNA, 1401 nt, Artificial Sequence
  derived and/or modified sequence opt4 from neuraminidase__InfluenzaB__AHM01441
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaccaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182821 - RNA, 1401 nt, Artificial Sequence; identical to SEQ ID NO: 182726
  derived and/or modified sequence opt4 from neuraminidase__InfluenzaB__AHM01463

SEQ ID NO: 182822 - RNA, 1401 nt, Artificial Sequence
  derived and/or modified sequence opt4 from neuraminidase__InfluenzaB__AHM01474
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcaucaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182823 - RNA, 1401 nt, Artificial Sequence
  derived and/or modified sequence opt4 from neuraminidase__InfluenzaB__AHM01485
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaucaugccccuggacugcaccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182824 - RNA, 1401 nt, Artificial Sequence; identical to SEQ ID NO: 182805
  derived and/or modified sequence opt4 from neuraminidase__InfluenzaB__AHM01496

SEQ ID NO: 182825 - RNA, 1401 nt, Artificial Sequence
  derived and/or modified sequence opt4 from neuraminidase__InfluenzaB__AHM01507
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucgugagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182826 - RNA, 1401 nt, Artificial Sequence; identical to SEQ ID NO: 182805
  derived and/or modified sequence opt4 from neuraminidase__InfluenzaB__AHM01518

SEQ ID NO: 182827 - RNA, 1401 nt, Artificial Sequence
  derived and/or modified sequence opt4 from neuraminidase__InfluenzaB__AHM01529
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcaccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagauccugcccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182828 - RNA, 1401 nt, Artificial Sequence; identical to SEQ ID NO: 182695
  derived and/or modified sequence opt4 from neuraminidase__InfluenzaB__AHM01540

SEQ ID NO: 182829 - RNA, 1401 nt, Artificial Sequence; identical to SEQ ID NO: 182805
  derived and/or modified sequence opt4 from neuraminidase__InfluenzaB__AHM01551

SEQ ID NO: 182830 - RNA, 1401 nt, Artificial Sequence; identical to SEQ ID NO: 182805
  derived and/or modified sequence opt4 from neuraminidase__InfluenzaB__AHM01562

SEQ ID NO: 182831 - RNA, 1401 nt, Artificial Sequence; identical to SEQ ID NO: 181312
  derived and/or modified sequence opt4 from neuraminidase__InfluenzaB__AHZ13597

SEQ ID NO: 182832 - RNA, 1404 nt, Artificial Sequence
  derived and/or modified sequence opt4 from neuraminidase__InfluenzaB__AHZ36701
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagaaagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182833 - RNA, 1404 nt, Artificial Sequence
  derived and/or modified sequence opt4 from neuraminidase__InfluenzaB__AHZ36756
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaugggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182834 - RNA, 1401 nt, Artificial Sequence
  derived and/or modified sequence opt4 from neuraminidase__InfluenzaB__AHZ36767
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccagaccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182835 - RNA, 1401 nt, Artificial Sequence
  derived and/or modified sequence opt4 from neuraminidase__InfluenzaB__AHZ36778
augcugcccagcaccauccagacccugacccuguuccugaccagcggcggcgugcugcugagccuguacgugagcgccagccugagcuaccugcuguacagcgacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagaauccagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgaggacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacaacggcgaccccugggccgacagcgacgcccugguguucagcggcgugaugaucagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacaugacccuguga

SEQ ID NO: 182836 - RNA, 1401 nt, Artificial Sequence
  derived and/or modified sequence opt4 from neuraminidase__InfluenzaB__AHZ36789
augcugcccagcaccauccagacccugacccuguuccugaccagcggcggcgugcugcugagccuguacgugagcgccagccugagcuaccugcuguacagcgacauccugcugaaguucagccccaccgagaucaccgcccagaccaugccccuggacugcgccaacgccagcaacgugcaggccgugaacagaagcgccaccaagggcgugacccugcugccccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaugaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182837 - RNA, 1401 nt, Artificial Sequence; identical to SEQ ID NO: 182836
  derived and/or modified sequence opt4 from neuraminidase__InfluenzaB__AHZ36800

SEQ ID NO: 182838 - RNA, 1401 nt, Artificial Sequence
  derived and/or modified sequence opt4 from neuraminidase__InfluenzaB__AHZ36811
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcaccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucagagagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182839 - RNA, 1404 nt, Artificial Sequence; identical to SEQ ID NO: 182833
  derived and/or modified sequence opt4 from neuraminidase__InfluenzaB__AHZ36822

SEQ ID NO: 182840 - RNA, 1401 nt, Artificial Sequence
  derived and/or modified sequence opt4 from neuraminidase__InfluenzaB__AHZ36833
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccagaccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaaggugagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182841 - RNA, 1401 nt, Artificial Sequence
  derived and/or modified sequence opt4 from neuraminidase__InfluenzaB__AHZ36844
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccagaccccuggacugcgccaacgccagcaacgugcaggccgugaacagaagcgccaccaaggaggugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182842 - RNA, 1401 nt, Artificial Sequence
  derived and/or modified sequence opt4 from neuraminidase__InfluenzaB__AHZ36855
augcugcccagcaccauccagacccugacccuguuccugaccagcggcggcgugcugcugagccuguacgugagcgccagccugagcuaccugcuguacagcgacauccugcugaaguucagccccaccgagaucaccgugcagaccaugccccuggacugcgccaacgccagcaacgugcaggccgugaacagaagcgccaccaagggcgugacccugcugccccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaugaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182843 - RNA, 1404 nt, Artificial Sequence; identical to SEQ ID NO: 182833
  derived and/or modified sequence opt4 from neuraminidase__InfluenzaB__AHZ36866

SEQ ID NO: 182844 - RNA, 1401 nt, Artificial Sequence
  derived and/or modified sequence opt4 from neuraminidase__InfluenzaB__AHZ36877
augcugcccagcaccauccagacccugacccuguuccugaccagcggcggcgugcugcugagccuguacgugagcgccagccugagcuaccugcuguacagcgacauccugcugaaguucagcccccccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182845 - RNA, 1404 nt, Artificial Sequence; identical to SEQ ID NO: 182833
  derived and/or modified sequence opt4 from neuraminidase__InfluenzaB__AHZ36888

SEQ ID NO: 182846 - RNA, 1404 nt, Artificial Sequence; identical to SEQ ID NO: 182833
  derived and/or modified sequence opt4 from neuraminidase__InfluenzaB__AHZ36899

SEQ ID NO: 182847 - RNA, 1404 nt, Artificial Sequence; identical to SEQ ID NO: 182833
  derived and/or modified sequence opt4 from neuraminidase__InfluenzaB__AHZ36910

SEQ ID NO: 182848 - RNA, 1401 nt, Artificial Sequence; identical to SEQ ID NO: 182835
  derived and/or modified sequence opt4 from neuraminidase__InfluenzaB__AHZ36921

SEQ ID NO: 182849 - RNA, 1401 nt, Artificial Sequence
  derived and/or modified sequence opt4 from neuraminidase__InfluenzaB__AHZ36932
augcugcccagcaccauccagacccugacccuguuccugaccagcggcggcgugcugcugagccuguacgugagcgccagccugagcuaccugcuguacagcgacauccugcugaaguucagccccaccgagaucaccgcccagaccaugccccuggacugcgccaacgccagcaacgugcaggccgugaacagaagcgccaccaagggcgugacccugcugccccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccauggagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaugaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182850 - RNA, 1401 nt, Artificial Sequence
  derived and/or modified sequence opt4 from neuraminidase__InfluenzaB__AHZ36943
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugccccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaugaaggacagaaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182851 - RNA, 1404 nt, Artificial Sequence; identical to SEQ ID NO: 182833
  derived and/or modified sequence opt4 from neuraminidase__InfluenzaB__AHZ36954

SEQ ID NO: 182852 - RNA, 1401 nt, Artificial Sequence
  derived and/or modified sequence opt4 from neuraminidase__InfluenzaB__AHZ36965
augcugcccagcaccauccagacccugacccuguuccugaccagcggcggcgugcugcugagccuguacgugagcgccagccugagcuaccugcuguacagcgacauccugcugaaguucagcccccccgagaucaacgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182853 - RNA, 1404 nt, Artificial Sequence; identical to SEQ ID NO: 182833
  derived and/or modified sequence opt4 from neuraminidase__InfluenzaB__AHZ36976

SEQ ID NO: 182854 - RNA, 1404 nt, Artificial Sequence; identical to SEQ ID NO: 182833
  derived and/or modified sequence opt4 from neuraminidase__InfluenzaB__AHZ36987

SEQ ID NO: 182855 - RNA, 1401 nt, Artificial Sequence; identical to SEQ ID NO: 182836
  derived and/or modified sequence opt4 from neuraminidase__InfluenzaB__AHZ36998

SEQ ID NO: 182856 - RNA, 1401 nt, Artificial Sequence
  derived and/or modified sequence opt4 from neuraminidase__InfluenzaB__AHZ37009
augcugcccagcaccauccagacccugacccuguuccugacccugggcggcgugcugcugagccuguacgugagcgccagccugagcuaccugcuguacagcgacauccugcugaaguucagccccaccgagaucaccgcccccaccaugccccugggcugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggaggccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182857 - RNA, 1401 nt, Artificial Sequence; identical to SEQ ID NO: 182834
  derived and/or modified sequence opt4 from neuraminidase__InfluenzaB__AHZ37020

SEQ ID NO: 182858 - RNA, 1401 nt, Artificial Sequence; identical to SEQ ID NO: 182836
  derived and/or modified sequence opt4 from neuraminidase__InfluenzaB__AHZ37031

SEQ ID NO: 182859 - RNA, 1401 nt, Artificial Sequence; identical to SEQ ID NO: 182834
  derived and/or modified sequence opt4 from neuraminidase__InfluenzaB__AHZ37042

SEQ ID NO: 182860 - RNA, 1401 nt, Artificial Sequence; identical to SEQ ID NO: 182836
  derived and/or modified sequence opt4 from neuraminidase__InfluenzaB__AHZ37064

SEQ ID NO: 182861 - RNA, 1401 nt, Artificial Sequence; identical to SEQ ID NO: 182834
  derived and/or modified sequence opt4 from neuraminidase__InfluenzaB__AHZ37075

SEQ ID NO: 182862 - RNA, 1401 nt, Artificial Sequence; identical to SEQ ID NO: 182834
  derived and/or modified sequence opt4 from neuraminidase__InfluenzaB__AHZ37086

SEQ ID NO: 182863 - RNA, 1401 nt, Artificial Sequence
  derived and/or modified sequence opt4 from neuraminidase__InfluenzaB__AHZ37097
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugccccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaugaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182864 - RNA, 1401 nt, Artificial Sequence; identical to SEQ ID NO: 182834
  derived and/or modified sequence opt4 from neuraminidase__InfluenzaB__AHZ37108

SEQ ID NO: 182865 - RNA, 1401 nt, Artificial Sequence
  derived and/or modified sequence opt4 from neuraminidase__InfluenzaB__AHZ41774
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggcagcaacgagugcagacacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacaacgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182866 - RNA, 1401 nt, Artificial Sequence; identical to SEQ ID NO: 181476
  derived and/or modified sequence opt4 from neuraminidase__InfluenzaB__AHZ41785

SEQ ID NO: 182867 - RNA, 1401 nt, Artificial Sequence; identical to SEQ ID NO: 181476
  derived and/or modified sequence opt4 from neuraminidase__InfluenzaB__AHZ41796

SEQ ID NO: 182868 - RNA, 1401 nt, Artificial Sequence
  derived and/or modified sequence opt4 from neuraminidase__InfluenzaB__AHZ41807
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucgagggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182869 - RNA, 1401 nt, Artificial Sequence
  derived and/or modified sequence opt4 from neuraminidase__InfluenzaB__AHZ41818
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugauggugaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccugguguucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacauggcccuguga

SEQ ID NO: 182870 - RNA, 1401 nt, Artificial Sequence; identical to SEQ ID NO: 181476
  derived and/or modified sequence opt4 from neuraminidase__InfluenzaB__AHZ41829

SEQ ID NO: 182871 - RNA, 1401 nt, Artificial Sequence
  derived and/or modified sequence opt4 from neuraminidase__InfluenzaB__AHZ41840
augcugcccagcaccauccagaugcugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcacgccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcagacacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggccagcaagaucggcagaugguacagcagaaccaugagcaagaccgagagaaagggcaugggccuguacgugaaguacgacggcgaccccuggaccgacagcgacgcccuggccuucagaggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182872 - RNA, 1401 nt, Artificial Sequence; identical to SEQ ID NO: 181476
  derived and/or modified sequence opt4 from neuraminidase__InfluenzaB__AHZ41851

SEQ ID NO: 182873 - RNA, 1401 nt, Artificial Sequence; identical to SEQ ID NO: 182722
  derived and/or modified sequence opt4 from neuraminidase__InfluenzaB__AHZ41862

SEQ ID NO: 182874 - RNA, 1401 nt, Artificial Sequence
  derived and/or modified sequence opt4 from neuraminidase__InfluenzaB__AHZ41873
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgcccaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182875 - RNA, 1401 nt, Artificial Sequence; identical to SEQ ID NO: 181312
  derived and/or modified sequence opt4 from neuraminidase__InfluenzaB__AIL94981

SEQ ID NO: 182876 - RNA, 1401 nt, Artificial Sequence; identical to SEQ ID NO: 181312
  derived and/or modified sequence opt4 from neuraminidase__InfluenzaB__AIL94992

SEQ ID NO: 182877 - RNA, 1401 nt, Artificial Sequence; identical to SEQ ID NO: 181337
  derived and/or modified sequence opt4 from neuraminidase__InfluenzaB__AIL95003

SEQ ID NO: 182878 - RNA, 1401 nt, Artificial Sequence
  derived and/or modified sequence opt4 from neuraminidase__InfluenzaB__AIL95014
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaacagaagcgccgccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacaugacccuguga

SEQ ID NO: 182879 - RNA, 1401 nt, Artificial Sequence; identical to SEQ ID NO: 181337
  derived and/or modified sequence opt4 from neuraminidase__InfluenzaB__AIL95025

SEQ ID NO: 182880 - RNA, 1401 nt, Artificial Sequence
  derived and/or modified sequence opt4 from neuraminidase__InfluenzaB__AIL95036
augcugagcagcaccauccagacccugacccuguuccugaccagcggcggcgugcugcugagccuguacgugagcgccagccugagcuaccugcuguacagcgacauccugcugaaguucagccccaaggagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182881 - RNA, 1401 nt, Artificial Sequence; identical to SEQ ID NO: 181337
  derived and/or modified sequence opt4 from neuraminidase__InfluenzaB__AIL95047

SEQ ID NO: 182882 - RNA, 1401 nt, Artificial Sequence; identical to SEQ ID NO: 181446
  derived and/or modified sequence opt4 from neuraminidase__InfluenzaB__AIL95058

SEQ ID NO: 182883 - RNA, 1401 nt, Artificial Sequence; identical to SEQ ID NO: 181395
  derived and/or modified sequence opt4 from neuraminidase__InfluenzaB__AIL95069

SEQ ID NO: 182884 - RNA, 1401 nt, Artificial Sequence
  derived and/or modified sequence opt4 from neuraminidase__InfluenzaB__AIL95080
augcugcccagcaccauccagacccugacccuguuccugaccagcggcggcgugcugcugagccuguacgugagcgccagccugagcuaccugcuguacagcgacauccugcugaaguucagccccaaggagaucaccgcccccaccaugccccuggacugcgccaacgccagcaacgugcaggccgugaaccacagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugcaacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccgacgacggcagcaucaccggccccugcgagagcaacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182885 - RNA, 1401 nt, Artificial Sequence; identical to SEQ ID NO: 181395
  derived and/or modified sequence opt4 from neuraminidase__InfluenzaB__AIL95091

SEQ ID NO: 182886 - RNA, 1401 nt, Artificial Sequence; identical to SEQ ID NO: 181337
  derived and/or modified sequence opt4 from neuraminidase__InfluenzaB__AIL95102

SEQ ID NO: 182887 - RNA, 1401 nt, Artificial Sequence
  derived and/or modified sequence opt4 from neuraminidase__InfluenzaB__AIL95113
augcugcccagcaccauccagacccugacccuguuccugaccagcggcggcgugcugcugagccuguacgugagcgccagccugagcuaccugcuguacagcgacauccugcugaaguucagccccaccggcaucaccgcccccaccaugccccuggacugcgccaacgccagcaacgugcaggccgugaacagaagcgccaccaagggcgugacccugcugccccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaugaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182888 - RNA, 1401 nt, Artificial Sequence; identical to SEQ ID NO: 182834
  derived and/or modified sequence opt4 from neuraminidase__InfluenzaB__AIL95124

SEQ ID NO: 182889 - RNA, 1401 nt, Artificial Sequence
  derived and/or modified sequence opt4 from neuraminidase__InfluenzaB__AKA54777
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaccggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182890 - RNA, 1401 nt, Artificial Sequence
  derived and/or modified sequence opt4 from neuraminidase__InfluenzaB__AKA54781
augcugcccagcaccauccagacccugacccuguuccugaccagcggcggcgugcugcugagccuguacgugagcgccagccugagcuaccugcuguaccuggacauccugcugaaguuccccagcaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaugaaggagaucuuccccaccggcagaacccagcacaccgaggagugcaccugcggcuucgccagcaacaagaccaucgagugcgugugcagagacaacagcuacaccgccaagagacccuucgugaagcugaacguggagaccgacaccgccgagaucagacugaugugcaccaagaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacgugaaguacaacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacaugacccuguga

SEQ ID NO: 182891 - RNA, 1401 nt, Artificial Sequence
  derived and/or modified sequence opt4 from neuraminidase__InfluenzaB__AKA54783
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccuguuccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182892 - RNA, 1401 nt, Artificial Sequence
  derived and/or modified sequence opt4 from neuraminidase__InfluenzaB__AKA54785
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcaacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182893 - RNA, 1401 nt, Artificial Sequence
  derived and/or modified sequence opt4 from neuraminidase__InfluenzaB__AKA54787
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182894 - RNA, 1401 nt, Artificial Sequence
  derived and/or modified sequence opt4 from neuraminidase__InfluenzaB__AKA54789
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182895 - RNA, 1401 nt, Artificial Sequence
  derived and/or modified sequence opt4 from neuraminidase__InfluenzaB__AKA54791
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgcccaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaucacccuguga

SEQ ID NO: 182896 - RNA, 1401 nt, Artificial Sequence; identical to SEQ ID NO: 182893
  derived and/or modified sequence opt4 from neuraminidase__InfluenzaB__AKA54793

SEQ ID NO: 182897 - RNA, 1401 nt, Artificial Sequence; identical to SEQ ID NO: 182893
  derived and/or modified sequence opt4 from neuraminidase__InfluenzaB__AKA54795

SEQ ID NO: 182898 - RNA, 1401 nt, Artificial Sequence; identical to SEQ ID NO: 182894
  derived and/or modified sequence opt4 from neuraminidase__InfluenzaB__AKA54797

SEQ ID NO: 182899 - RNA, 1401 nt, Artificial Sequence
  derived and/or modified sequence opt4 from neuraminidase__InfluenzaB__AKA54799
augcugcccagcaccauccagacccugacccuguuccugaccagcggcggcgugcugcugagccuguacgugagcgccagccugagcuaccugcuguacagcgacauccugcugaaguucagccagaccgagaucaccgcccccaucaugccccuggacugcgccaacgccagcaacgugcaggccgugaaccacagcgccgccaagggcgugacccugcugcugcccgagcccgaguggaccuaccccagacugagcugccccggcagcaccuuccagaaggcccugcugaucagcccccacagauucggcgagaucaagggcaacagcgccccccugaucaucagagagcccuucaucgccugcggccccaccgagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacagcaacgcccugcugaagaucaaguacggcgaggccuacaccgacaccuaccacagcuacgagaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgagaccuaccuggacacccccagacccaacgacggcagcaucaccggccccugcgagagcgacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcguggacauggcccuguga

SEQ ID NO: 182900 - RNA, 1401 nt, Artificial Sequence; identical to SEQ ID NO: 182894
  derived and/or modified sequence opt4 from neuraminidase__InfluenzaB__AKA54801

SEQ ID NO: 182901 - RNA, 1401 nt, Artificial Sequence
  derived and/or modified sequence opt4 from neuraminidase__InfluenzaB__AKA54803
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaacggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182902 - RNA, 1401 nt, Artificial Sequence; identical to SEQ ID NO: 182894
  derived and/or modified sequence opt4 from neuraminidase__InfluenzaB__AKA54805

SEQ ID NO: 182903 - RNA, 1401 nt, Artificial Sequence
  derived and/or modified sequence opt4 from neuraminidase__InfluenzaB__AKA54807
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaucacccuguga

SEQ ID NO: 182904 - RNA, 1401 nt, Artificial Sequence
  derived and/or modified sequence opt4 from neuraminidase__InfluenzaB__AKA54809
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccuucaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182905 - RNA, 1401 nt, Artificial Sequence; identical to SEQ ID NO: 182894
  derived and/or modified sequence opt4 from neuraminidase__InfluenzaB__AKA54811

SEQ ID NO: 182906 - RNA, 1401 nt, Artificial Sequence
  derived and/or modified sequence opt4 from neuraminidase__InfluenzaB__AKA54813
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcaucgaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182907 - RNA, 1401 nt, Artificial Sequence; identical to SEQ ID NO: 182894
  derived and/or modified sequence opt4 from neuraminidase__InfluenzaB__AKA54815

SEQ ID NO: 182908 - RNA, 1401 nt, Artificial Sequence
  derived and/or modified sequence opt4 from neuraminidase__InfluenzaB__AKA54817
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcguggagauggugcacgacggcggcaagaccaccuggcacagcgccgccaccgccaucuacugccugaugggcagcggccagcugcugugggacaccgugaccggcgugaacaugacccuguga

SEQ ID NO: 182909 - RNA, 1401 nt, Artificial Sequence; identical to SEQ ID NO: 182894
  derived and/or modified sequence opt4 from neuraminidase__InfluenzaB__AKA54819

SEQ ID NO: 182910 - RNA, 1401 nt, Artificial Sequence; identical to SEQ ID NO: 182894
  derived and/or modified sequence opt4 from neuraminidase__InfluenzaB__AKA54821

SEQ ID NO: 182911 - RNA, 1401 nt, Artificial Sequence; identical to SEQ ID NO: 182894
  derived and/or modified sequence opt4 from neuraminidase__InfluenzaB__AKA54823

SEQ ID NO: 182912 - RNA, 1401 nt, Artificial Sequence; identical to SEQ ID NO: 182894
  derived and/or modified sequence opt4 from neuraminidase__InfluenzaB__AKA54825

SEQ ID NO: 182913 - RNA, 1401 nt, Artificial Sequence; identical to SEQ ID NO: 182894
  derived and/or modified sequence opt4 from neuraminidase__InfluenzaB__AKA54827

SEQ ID NO: 182914 - RNA, 1401 nt, Artificial Sequence
  derived and/or modified sequence opt4 from neuraminidase__InfluenzaB__AKA54829
augcugcccagcaccauccagacccugacccuguuccugaccagcggcggcgugcugcugagccuguacgugagcgccagccugagcuaccugcuguacagcgacauccugcugaagcugagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaagacccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182915 - RNA, 1401 nt, Artificial Sequence
  derived and/or modified sequence opt4 from neuraminidase__InfluenzaB__AKA54831
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccaggacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182916 - RNA, 1401 nt, Artificial Sequence; identical to SEQ ID NO: 182894
  derived and/or modified sequence opt4 from neuraminidase__InfluenzaB__AKA54833

SEQ ID NO: 182917 - RNA, 1401 nt, Artificial Sequence
  derived and/or modified sequence opt4 from neuraminidase__InfluenzaB__AKA54837
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaacggcaacagcgccccccugaucgugagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcaacgagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182918 - RNA, 1401 nt, Artificial Sequence
  derived and/or modified sequence opt4 from neuraminidase__InfluenzaB__AKA54839
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaaggaggugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182919 - RNA, 1401 nt, Artificial Sequence
  derived and/or modified sequence opt4 from neuraminidase__InfluenzaB__AKA54841
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacgagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcgugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacaucgcccuguga

SEQ ID NO: 182920 - RNA, 1401 nt, Artificial Sequence
  derived and/or modified sequence opt4 from neuraminidase__InfluenzaB__AKA54843
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacgagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcgugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182921 - RNA, 1401 nt, Artificial Sequence
  derived and/or modified sequence opt4 from neuraminidase__InfluenzaB__AKA54845
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaacggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacgagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182922 - RNA, 1401 nt, Artificial Sequence; identical to SEQ ID NO: 182726
  derived and/or modified sequence opt4 from neuraminidase__InfluenzaB__AKA54847

SEQ ID NO: 182923 - RNA, 1401 nt, Artificial Sequence
  derived and/or modified sequence opt4 from neuraminidase__InfluenzaB__AKA54849
augcugcccagcaccauccagacccugacccuguuccugaccagcggcggcgugcugcugagccuguacgugagcgccagccugagcuaccugcuguacagcgacauccugcugaaguucagcagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaacggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacgagggcggcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182924 - RNA, 1401 nt, Artificial Sequence
  derived and/or modified sequence opt4 from neuraminidase__InfluenzaB__AKA54851
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaucgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182925 - RNA, 1401 nt, Artificial Sequence
  derived and/or modified sequence opt4 from neuraminidase__InfluenzaB__AKA54853
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacgagggcagcggcggcgugaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcgugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182926 - RNA, 1401 nt, Artificial Sequence
  derived and/or modified sequence opt4 from neuraminidase__InfluenzaB__AKA54855
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcuggacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182927 - RNA, 1401 nt, Artificial Sequence
  derived and/or modified sequence opt4 from neuraminidase__InfluenzaB__AKT07927
augccccccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccagaggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccuggaccgacagcgacgcccuggccuucggcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182928 - RNA, 1401 nt, Artificial Sequence; identical to SEQ ID NO: 181639
  derived and/or modified sequence opt4 from neuraminidase__InfluenzaB__AKT07931

SEQ ID NO: 182929 - RNA, 1401 nt, Artificial Sequence
  derived and/or modified sequence opt4 from neuraminidase__InfluenzaB__AKT07933
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182930 - RNA, 1401 nt, Artificial Sequence; identical to SEQ ID NO: 181639
  derived and/or modified sequence opt4 from neuraminidase__InfluenzaB__AKT07935

SEQ ID NO: 182931 - RNA, 1401 nt, Artificial Sequence; identical to SEQ ID NO: 181639
  derived and/or modified sequence opt4 from neuraminidase__InfluenzaB__AKT07937

SEQ ID NO: 182932 - RNA, 1401 nt, Artificial Sequence; identical to SEQ ID NO: 181481
  derived and/or modified sequence opt4 from neuraminidase__InfluenzaB__AKT07939

SEQ ID NO: 182933 - RNA, 1401 nt, Artificial Sequence; identical to SEQ ID NO: 181639
  derived and/or modified sequence opt4 from neuraminidase__InfluenzaB__AKT07941

SEQ ID NO: 182934 - RNA, 1401 nt, Artificial Sequence; identical to SEQ ID NO: 181639
  derived and/or modified sequence opt4 from neuraminidase__InfluenzaB__AKT07945

SEQ ID NO: 182935 - RNA, 1401 nt, Artificial Sequence
  derived and/or modified sequence opt4 from neuraminidase__InfluenzaB__AKT07947
augcugcccagcaccauccagacccugacccuguuccugaccagcggcggcgugcugcugagccuguacgugagcgccagccugagcuaccugcuguacagcgacauccugcugaaguucagccccaccgagaucaccgcccccgccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcguggacauggugcacgacugcggcaaggagaccuggcacagcgccgccaccgccaucuacugccugaugggcagcggccagcugcugugggacaccgugaccggcguggacauggcccuguga

SEQ ID NO: 182936 - RNA, 1401 nt, Artificial Sequence; identical to SEQ ID NO: 182894
  derived and/or modified sequence opt4 from neuraminidase__InfluenzaB__AKU40585

SEQ ID NO: 182937 - RNA, 1401 nt, Artificial Sequence; identical to SEQ ID NO: 182894
  derived and/or modified sequence opt4 from neuraminidase__InfluenzaB__AKU40596

SEQ ID NO: 182938 - RNA, 1401 nt, Artificial Sequence
  derived and/or modified sequence opt4 from neuraminidase__InfluenzaB__AKU40607
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaccccccuggacugcgccaacgccagcaacgcccaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182939 - RNA, 1401 nt, Artificial Sequence
  derived and/or modified sequence opt4 from neuraminidase__InfluenzaB__AKU40618
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaacaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182940 - RNA, 1401 nt, Artificial Sequence
  derived and/or modified sequence opt4 from neuraminidase__InfluenzaB__AKU40640
augcugcccagcaccauccagacccugacccuguuccugaccagcggcggcgugcugcugagccuguacgugagcgccagccugagcuaccugcuguacagcgacauccugcugaaguucagcagaaccgagaucgccgcccccaucaugccccuggacugcgccaacgccagcaacgugcaggccgugaacagaagcgccaccaagggcguggcccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacaacaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccaacgacggcagcaucaccggccccugcgagagcaacggcgacaagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182941 - RNA, 1401 nt, Artificial Sequence; identical to SEQ ID NO: 182894
  derived and/or modified sequence opt4 from neuraminidase__InfluenzaB__AKU40662

SEQ ID NO: 182942 - RNA, 1401 nt, Artificial Sequence
  derived and/or modified sequence opt4 from neuraminidase__InfluenzaB__AKU40673
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagagcgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182943 - RNA, 1401 nt, Artificial Sequence; identical to SEQ ID NO: 182894
  derived and/or modified sequence opt4 from neuraminidase__InfluenzaB__AKU40684

SEQ ID NO: 182944 - RNA, 1401 nt, Artificial Sequence; identical to SEQ ID NO: 182894
  derived and/or modified sequence opt4 from neuraminidase__InfluenzaB__AKU40695

SEQ ID NO: 182945 - RNA, 1401 nt, Artificial Sequence; identical to SEQ ID NO: 182894
  derived and/or modified sequence opt4 from neuraminidase__InfluenzaB__AKU40706

SEQ ID NO: 182946 - RNA, 1401 nt, Artificial Sequence; identical to SEQ ID NO: 182894
  derived and/or modified sequence opt4 from neuraminidase__InfluenzaB__AKU40717

SEQ ID NO: 182947 - RNA, 1401 nt, Artificial Sequence
  derived and/or modified sequence opt4 from neuraminidase__InfluenzaB__AKU40728
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgcccaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182948 - RNA, 1401 nt, Artificial Sequence
  derived and/or modified sequence opt4 from neuraminidase__InfluenzaB__AKU40739
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgagaccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182949 - RNA, 1401 nt, Artificial Sequence
  derived and/or modified sequence opt4 from neuraminidase__InfluenzaB__AKU40750
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaucccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182950 - RNA, 1401 nt, Artificial Sequence; identical to SEQ ID NO: 182894
  derived and/or modified sequence opt4 from neuraminidase__InfluenzaB__AKU40761

SEQ ID NO: 182951 - RNA, 1401 nt, Artificial Sequence; identical to SEQ ID NO: 182894
  derived and/or modified sequence opt4 from neuraminidase__InfluenzaB__AKU40772

SEQ ID NO: 182952 - RNA, 1401 nt, Artificial Sequence; identical to SEQ ID NO: 182894
  derived and/or modified sequence opt4 from neuraminidase__InfluenzaB__AKU40783

SEQ ID NO: 182953 - RNA, 1401 nt, Artificial Sequence
  derived and/or modified sequence opt4 from neuraminidase__InfluenzaB__AKU40794
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacaccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaagagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182954 - RNA, 1401 nt, Artificial Sequence; identical to SEQ ID NO: 182894
  derived and/or modified sequence opt4 from neuraminidase__InfluenzaB__AKU40805

SEQ ID NO: 182955 - RNA, 1401 nt, Artificial Sequence; identical to SEQ ID NO: 182894
  derived and/or modified sequence opt4 from neuraminidase__InfluenzaB__AKU40816

SEQ ID NO: 182956 - RNA, 1401 nt, Artificial Sequence; identical to SEQ ID NO: 182894
  derived and/or modified sequence opt4 from neuraminidase__InfluenzaB__AKU40827

SEQ ID NO: 182957 - RNA, 1401 nt, Artificial Sequence; identical to SEQ ID NO: 182894
  derived and/or modified sequence opt4 from neuraminidase__InfluenzaB__AKU40838

SEQ ID NO: 182958 - RNA, 1401 nt, Artificial Sequence; identical to SEQ ID NO: 182894
  derived and/or modified sequence opt4 from neuraminidase__InfluenzaB__AKU40849

SEQ ID NO: 182959 - RNA, 1401 nt, Artificial Sequence; identical to SEQ ID NO: 182894
  derived and/or modified sequence opt4 from neuraminidase__InfluenzaB__AKU40860

SEQ ID NO: 182960 - RNA, 1401 nt, Artificial Sequence
  derived and/or modified sequence opt4 from neuraminidase__InfluenzaB__AKU40871
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcguggccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccugacccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182961 - RNA, 1401 nt, Artificial Sequence; identical to SEQ ID NO: 182894
  derived and/or modified sequence opt4 from neuraminidase__InfluenzaB__AKU40882

SEQ ID NO: 182962 - RNA, 1401 nt, Artificial Sequence
  derived and/or modified sequence opt4 from neuraminidase__InfluenzaB__AKU40893
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacgacggcgaccccugggccgacagcggcgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182963 - RNA, 1401 nt, Artificial Sequence; identical to SEQ ID NO: 182894
  derived and/or modified sequence opt4 from neuraminidase__InfluenzaB__AKU40904

SEQ ID NO: 182964 - RNA, 1401 nt, Artificial Sequence
  derived and/or modified sequence opt4 from neuraminidase__InfluenzaB__AKU40915
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugcccauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182965 - RNA, 1401 nt, Artificial Sequence; identical to SEQ ID NO: 182894
  derived and/or modified sequence opt4 from neuraminidase__InfluenzaB__AKU40926

SEQ ID NO: 182966 - RNA, 1401 nt, Artificial Sequence; identical to SEQ ID NO: 182948
  derived and/or modified sequence opt4 from neuraminidase__InfluenzaB__AKU40937

SEQ ID NO: 182967 - RNA, 1401 nt, Artificial Sequence; identical to SEQ ID NO: 182894
  derived and/or modified sequence opt4 from neuraminidase__InfluenzaB__AKU40948

SEQ ID NO: 182968 - RNA, 1401 nt, Artificial Sequence; identical to SEQ ID NO: 182894
  derived and/or modified sequence opt4 from neuraminidase__InfluenzaB__AKU40959

SEQ ID NO: 182969 - RNA, 1401 nt, Artificial Sequence; identical to SEQ ID NO: 182894
  derived and/or modified sequence opt4 from neuraminidase__InfluenzaB__AKU40970

SEQ ID NO: 182970 - RNA, 1401 nt, Artificial Sequence; identical to SEQ ID NO: 182894
  derived and/or modified sequence opt4 from neuraminidase__InfluenzaB__AKU40981

SEQ ID NO: 182971 - RNA, 1401 nt, Artificial Sequence; identical to SEQ ID NO: 182894
  derived and/or modified sequence opt4 from neuraminidase__InfluenzaB__AKU40991

SEQ ID NO: 182972 - RNA, 1401 nt, Artificial Sequence; identical to SEQ ID NO: 182894
  derived and/or modified sequence opt4 from neuraminidase__InfluenzaB__AKU41002

SEQ ID NO: 182973 - RNA, 1401 nt, Artificial Sequence; identical to SEQ ID NO: 182894
  derived and/or modified sequence opt4 from neuraminidase__InfluenzaB__AKU41013

SEQ ID NO: 182974 - RNA, 1401 nt, Artificial Sequence; identical to SEQ ID NO: 182894
  derived and/or modified sequence opt4 from neuraminidase__InfluenzaB__AKU41024

SEQ ID NO: 182975 - RNA, 1401 nt, Artificial Sequence; identical to SEQ ID NO: 181481
  derived and/or modified sequence opt4 from neuraminidase__InfluenzaB__EPI173278

SEQ ID NO: 182976 - RNA, 1401 nt, Artificial Sequence; identical to SEQ ID NO: 181481
  derived and/or modified sequence opt4 from neuraminidase__InfluenzaB__EPI498049

SEQ ID NO: 182977 - RNA, 1401 nt, Artificial Sequence; identical to SEQ ID NO: 181481
  derived and/or modified sequence opt4 from neuraminidase__InfluenzaB__AFH57913

SEQ ID NO: 182978 - RNA, 1401 nt, Artificial Sequence; identical to SEQ ID NO: 181481
  derived and/or modified sequence opt4 from neuraminidase__InfluenzaB__EPI827074

SEQ ID NO: 182979 - RNA, 1401 nt, Artificial Sequence; identical to SEQ ID NO: 181481
  derived and/or modified sequence opt4 from neuraminidase__InfluenzaB__EPI244698

SEQ ID NO: 182980 - RNA, 1401 nt, Artificial Sequence; identical to SEQ ID NO: 181481
  derived and/or modified sequence opt4 from neuraminidase__InfluenzaB__EPI244701

SEQ ID NO: 182981 - RNA, 1401 nt, Artificial Sequence; identical to SEQ ID NO: 182894
  derived and/or modified sequence opt4 from neuraminidase__InfluenzaB__EPI540672

SEQ ID NO: 182982 - RNA, 1401 nt, Artificial Sequence; identical to SEQ ID NO: 182894
  derived and/or modified sequence opt4 from neuraminidase__InfluenzaB__EPI829465

SEQ ID NO: 182983 - RNA, 1401 nt, Artificial Sequence
  derived and/or modified sequence opt4 from neuraminidase__InfluenzaB__EPI684428
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaccaugccccuggacugcgccaacgccagcaacgugcaggccgugaacagaagcaccaccaagggcgugaccccccuguuccccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182984 - RNA, 1401 nt, Artificial Sequence; identical to SEQ ID NO: 181503
  derived and/or modified sequence opt4 from neuraminidase__InfluenzaB__AFH58451

SEQ ID NO: 182985 - RNA, 1401 nt, Artificial Sequence; identical to SEQ ID NO: 181481
  derived and/or modified sequence opt4 from neuraminidase__InfluenzaB__EPI173280

SEQ ID NO: 182986 - RNA, 1401 nt, Artificial Sequence; identical to SEQ ID NO: 181481
  derived and/or modified sequence opt4 from neuraminidase__InfluenzaB__EPI186302

SEQ ID NO: 182987 - RNA, 1401 nt, Artificial Sequence
  derived and/or modified sequence opt4 from neuraminidase__InfluenzaB__EPI636339
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucguggccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacggcggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182988 - RNA, 1401 nt, Artificial Sequence; identical to SEQ ID NO: 182987
  derived and/or modified sequence opt4 from neuraminidase__InfluenzaB__EPI645996

SEQ ID NO: 182989 - RNA, 1401 nt, Artificial Sequence
  derived and/or modified sequence opt4 from neuraminidase__InfluenzaB__EPI539770
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgcccaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccaccaucuacugccugaugggcagcggccagcugcugugggacaccgugaccggcgugaacaucacccuguga

SEQ ID NO: 182990 - RNA, 1401 nt, Artificial Sequence; identical to SEQ ID NO: 182989
  derived and/or modified sequence opt4 from neuraminidase__InfluenzaB__EPI551248

SEQ ID NO: 182991 - RNA, 1401 nt, Artificial Sequence; identical to SEQ ID NO: 182989
  derived and/or modified sequence opt4 from neuraminidase__InfluenzaB__EPI544258

SEQ ID NO: 182992 - RNA, 1401 nt, Artificial Sequence; identical to SEQ ID NO: 182894
  derived and/or modified sequence opt4 from neuraminidase__InfluenzaB__EPI592698

SEQ ID NO: 182993 - RNA, 1401 nt, Artificial Sequence; identical to SEQ ID NO: 182894
  derived and/or modified sequence opt4 from neuraminidase__InfluenzaB__EPI592706

SEQ ID NO: 182994 - RNA, 1401 nt, Artificial Sequence
  derived and/or modified sequence opt4 from neuraminidase__InfluenzaB__EPI693093
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggagagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgccaucuacugccugaugggcagcggccagcugcugugggacaccgugaccggcgugaacaugacccuguga

SEQ ID NO: 182995 - RNA, 1401 nt, Artificial Sequence
  derived and/or modified sequence opt4 from neuraminidase__InfluenzaB__EPI678795
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcgugaccuuccugcugcccgagcccgaguggaccuaccccagacugagcugccccggcagcaccuuccagaaggcccugcugaucagcccccacagauucggcgagaccaagggcaacagcgccccccugaucaucagagagcccuucguggccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagauacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaaugaagagcaagaucggcagaugguacagcagaaccaugagcaagaccgagagaaugggcaugggccuguacgugaaguacggcggcaaccccugggccgacagcgacgcccugaccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 182996 - RNA, 1401 nt, Artificial Sequence; identical to SEQ ID NO: 182995
  derived and/or modified sequence opt4 from neuraminidase__InfluenzaB__EPI721063

SEQ ID NO: 182997 - RNA, 1401 nt, Artificial Sequence; identical to SEQ ID NO: 181415
  derived and/or modified sequence opt4 from neuraminidase__InfluenzaB__EPI328903

SEQ ID NO: 182998 - RNA, 1401 nt, Artificial Sequence
  derived and/or modified sequence opt4 from neuraminidase__InfluenzaB__EPI543192
augcugcccagcaccauccagacccugacccuguuccugaccagcggcggcgugcugcugagccuguacgugagcgccagccugagcuaccugcuguaccuggacauccugcugaaguuccccagcaccgagaucaccgcccccaccaugccccuggacugcgccaacgccagcaacgugcaggccgugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaagaucaaguacggcgaggccuacaccgacaccuaccacagcuacgccaacaacauccugagaacccaggagagcgccugcaacugcaucggcggcaacugcuaccugaugaucaccgacggcagcgccagcggcgugagcgagugcagauuccugaagaucagagagggcagaaucaugaaggagaucuuccccaccggcagaacccagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucaccggccccugcgagagcaacggcggcaagggcagcggcggcaucaagggcggcuucgugcaccagagaauggccagcaagaucggcagaugguacagcagaaccaugagcaagaccgagagaaagggcaugggccuguacaucaaguacaacggcgaccccugggccgacagcgacgcccugaccuucagcggcgugauggugagcauggaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcgugaacaugacccuguga

SEQ ID NO: 182999 - RNA, 1401 nt, Artificial Sequence; identical to SEQ ID NO: 182998
  derived and/or modified sequence opt4 from neuraminidase__InfluenzaB__EPI500360

SEQ ID NO: 183000 - RNA, 1401 nt, Artificial Sequence
  derived and/or modified sequence opt4 from neuraminidase__InfluenzaB__EPI543186
augcugcccagcaccauccagacccugacccuguuccugaccagcggcggcgugcugcugagccuguacgugagcgccagccugagcuaccugcuguacagcgacauccugcugaaguucagcagaaccgaggugaccgcccccaucaugccccuggacugcgccaacgccagcaacgugcaggccgugaacagaagcgccaccaagggcgugaccccccugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugcugaagaucaaguacggcgaggccuacaccgacaccuaccacagcuacgccaagaacauccugagaacccaggagagcgccugcaacugcaucggcggcgacugcuaccugaugaucaccgacggccccgccagcggcaucagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccaacgacggcagcaucaccggccccugcgagagcgacggcgacgagggcagcggcggcaucaagggcggcuucgugcaccagagaauggccagcaagaucggcagaugguacagcagaaccaugagcaagaccaagagaaugggcaugggccuguacgugaaguacgacggcgaccccuggaccgacagcgaggcccuggcccugagcggcgugauggugagcauggaggagcccggcugguacagcuucggcuucgagaucaaggacaagaagugcgacgugcccugcaucggcaucgagauggugcacgacggcggcaagaccaccuggcacagcgccgccaccgugaucuacugccugaugggcagcggccagcugcugugggacaccgugaccggcgugaacaugacccuguga

SEQ ID NO: 183001 - RNA, 1401 nt, Artificial Sequence; identical to SEQ ID NO: 183000
  derived and/or modified sequence opt4 from neuraminidase__InfluenzaB__EPI536448

SEQ ID NO: 183002 - RNA, 1401 nt, Artificial Sequence
  derived and/or modified sequence opt4 from neuraminidase__InfluenzaB__NP_056663
augcugcccagcaccgugcagacccugacccugcugcugaccagcggcggcgugcugcugagccuguacgugagcgccagccugagcuaccugcuguacagcgacgugcugcugaaguucagcagcaccaagaccaccgcccccaccaugagccuggagugcaccaacgccagcaacgcccagaccgugaaccacagcgccaccaaggagaugaccuuccccccccccgagcccgaguggaccuaccccagacugagcugccagggcagcaccuuccagaaggcccugcugaucagcccccacagauucggcgagaucaagggcaacagcgccccccugaucaucagagagcccuucguggccugcggccccaaggagugcagacacuucgcccugacccacuacgccgcccagcccggcggcuacuacaacggcaccagaaaggacagaaacaagcugagacaccuggugagcgugaagcugggcaagauccccaccguggagaacagcaucuuccacauggccgccuggagcggcagcgccugccacgacggcagagaguggaccuacaucggcguggacggccccgacaacgacgcccuggugaagaucaaguacggcgaggccuacaccgacaccuaccacagcuacgcccacaacauccugagaacccaggagagcgccugcaacugcaucggcggcgacugcuaccugaugaucaccgacggcagcgccagcggcaucagcaagugcagauuccugaagaucagagagggcagaaucaucaaggagauccugcccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucgccggccccugcgagagcaacggcgacaaguggcugggcggcaucaagggcggcuucgugcaccagagaauggccagcaagaucggcagaugguacagcagaaccaugagcaagaccaacagaaugggcauggagcuguacgugaaguacgacggcgaccccuggaccgacagcgacgcccugacccugagcggcgugauggugagcaucgaggagcccggcugguacagcuucggcuucgagaucaaggacaagaagugcgacgugcccugcaucggcaucgagauggugcacgacggcggcaaggacaccuggcacagcgccgccaccgccaucuacugccugaugggcagcggccagcugcugugggacaccgugaccggcguggacauggcccuguga

SEQ ID NO: 183003 - RNA, 1401 nt, Artificial Sequence
  derived and/or modified sequence opt4 from neuraminidase__InfluenzaB__ABG85180
augcugcccagcaccgugcagacccugacccugcugcugaccagcggcggcgugcugcugagccuguacgugagcgccagccugagcuaccugcuguacagcgacgugcugcugaaguucagcagcaccaagaccaccgcccccaccaugagccuggagugcaccaacgccagcaacgcccagaccgugaacuacagcgccaccaaggagaugaccuuccccccccccgagcccgaguggaccuaccccagacugagcugccagggcagcaccuuccagaaggcccugcugaucagcccccacagauucggcgagaucaagggcaacagcgccccccugaucaucagagagcccuucguggccugcggccccaaggagugcagacacuucgcccugacccacuacgccgcccagcccggcggcuacuaccacggcaccagaaaggacagaaacaagcugagacaccuggugagcgugaagcugggcaagauccccaccguggagaacagcaucuuccacauggccgccuggagcggcagcgccugccacgacggcagagaguggaccuacaucggcguggacggccccgacaacgacgcccuggugaagaucaaguacggcgaggccuacaccgacaccuaccacagcuacgcccacaacauccugagaacccaggagagcgccugcaacugcaucggcggcgacugcuaccugaugaucaccgacggcagcgccagcggcaucagcaagugcagauuccugaagaucagagagggcagaaucaucaaggagauccugcccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccaagaccuaccuggacacccccagacccgacgacggcagcaucgccggccccugcgagagcaacggcgacaagggccugggcggcaucaagggcggcuucgugcaccagagaauggccuucaagaucggcagaugguacagcagaaccaugagcaagaccaacagaaugggcauggagcuguacgugaaguacgacggcgaccccuggaccgacagcgacgcccugacccugagcggcgugauggugagcaucgaggagcccggcugguacagcuucggcuucgagaucaaggacaagaagugcgacgugcccugcaucggcaucgagauggugcacgacggcggcgaggacaccuggcacagcgccgccaccgccaucuacugccugaugggcagcggccagcugcugugggacaccgugaccggcaucgacauggcccuguga

SEQ ID NO: 183004 - RNA, 1401 nt, Artificial Sequence; identical to SEQ ID NO: 182893
  derived and/or modified sequence opt4 from neuraminidase__InfluenzaB__EPI376345

SEQ ID NO: 183005 - RNA, 1401 nt, Artificial Sequence; identical to SEQ ID NO: 182893
  derived and/or modified sequence opt4 from neuraminidase__InfluenzaB__EPI368424

SEQ ID NO: 183006 - RNA, 1401 nt, Artificial Sequence
  derived and/or modified sequence opt4 from neuraminidase__InfluenzaB__EPI331150
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccaugaacagaagcgccaccaagggcgugacccugcugcugcccgagcccgaguggaccuaccccagacugagcugccccggcagcaccuuccagaaggcccugcugaucagcccccacagauucggcgagaccaagggcaacagcgccccccugaucaucagagagcccuucaucgccugcggccccaacgagugcaagcacuucgcccugacccacuacgccgcccagcccggcggcuacuacaacggcaccagaggcgacagaaacaagcugagacaccugaucagcgugaagcugggcaagauccccaccguggagaacagcaucuuccacauggccgccuggagcggcagcgccugccacgacggcaaggaguggaccuacaucggcguggacggccccgacaacaacgcccugcugaaggugaaguacggcgaggccuacaccgacaccuaccacagcuacgccaacaagauccugagaacccaggagagcgccugcaacugcaucggcggcaacugcuaccugaugaucaccgacggcagcgccagcggcgugagcgagugcagauuccugaagaucagagagggcagaaucaucaaggagaucuuccccaccggcagagugaagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgacaccuaccuggacacccccagacccaacgacggcagcaucaccggccccugcgagagcgacggcgacaagggcagcggcggcaucaagggcggcuucgugcaccagagaauggagagcaagaucggcagaugguacagcagaaccaugagcaagaccgagagaaugggcaugggccuguacgugaaguacgacggcgaccccugggccgacagcgacgcccuggccuucagcggcgugauggugagcaugaaggagcccggcugguacagcuucggcuucgagaucaaggacaagaagugcgacgugcccugcaucggcaucgagauggugcacgacggcggcaaggagaccuggcacagcgccgccaccgccaucuacugccugaugggcagcggccagcugcugugggacaccgugaccggcguggacauggcccuguga

SEQ ID NO: 183007 - RNA, 1401 nt, Artificial Sequence; identical to SEQ ID NO: 183006
  derived and/or modified sequence opt4 from neuraminidase__InfluenzaB__EPI358089

SEQ ID NO: 183008 - RNA, 1401 nt, Artificial Sequence; identical to SEQ ID NO: 181152
  derived and/or modified sequence opt4 from neuraminidase__InfluenzaB__ABL76698

SEQ ID NO: 183009 - RNA, 1401 nt, Artificial Sequence
  derived and/or modified sequence opt4 from neuraminidase__InfluenzaB__AAD42328
augcugcccagcaccauccagacccugacccuguuccugaccagcggcggcgugcugcugagccuguacgugagcgccagccugagcuaccugcuguacagcgacauccugcugaaguucagccccaccgagaucaccgcccccaccaugccccuggacugcgccaacgccagcaacgugcaggccgugaacagaagcgccaccaagggcaugacccugcugcugcccgagcccgaguggaccuaccccagacugagcugccccggcagcaccuuccagaaggcccugcugaucagcccccacagauucggcgagaccagaggcaacagcgccccccugaccaucagagagcccuucaucgccugcggccccaaggagugcaagcacuucgcccugacccacuacgccgcccagcccggcggcuacuacaacggcaccagagaggacagaaacaagcugagacaccugaucagcgugaagcugggcaagauccccaccguggagaacagcaucuuccacauggccgccuggagcggcagcgccugccacgacggcagagaguggaccuacaucggcguggacggccccgacagcaacgcccugaucaagaucaaguacggcgaggccuacaccgacaccuaccacagcuacgccaacaacauccugagaacccaggagagcgccugcaacugcaucggcggcgacugcuaccugaugaucaccgacggcagcgccagcggcaucagcaagugcagauuccugaagaucagagagggcagaaucaucaaggagaucuuccccaccggcagaguggagcacaccgaggagugcaccugcggcuucgccagcaacaagaccaucgagugcgccugcagagacaacagcuacaccgccaagagacccuucgugaagcugaacguggagaccgacaccgccgagaucagacugaugugcaccgagaccuaccuggacacccccagacccgacgacggcagcaucaccggccccugcgagagcaacggcgacaagggcagaggcggcaucaagggcggcuucgugcaccagagaauggccagcaagaucggcagaugguacagcagaaccaugagcaagaccaagagaaugggcauggagcuguacgugaaguacgacggcgaccccuggaucgacagcgacgcccuggcccccagcggcgugauggugagcauggaggagcccggcugguacagcuucggcuucgagaucaaggacaagaagugcgacgugcccugcaucggcaucgagauggugcacgacggcggcaagaagaccuggcacagcgccgccaccgccaucuacugccugaugggcagcggccagcugcugugggacaccgugaccggcguggacagaagcguguga

SEQ ID NO: 183010 - RNA, 1401 nt, Artificial Sequence; identical to SEQ ID NO: 182695
  derived and/or modified sequence opt4 from neuraminidase__InfluenzaB__EPI541349

SEQ ID NO: 183011 - RNA, 1401 nt, Artificial Sequence; identical to SEQ ID NO: 182894
  derived and/or modified sequence opt4 from neuraminidase__InfluenzaB__EPI541759

SEQ ID NO: 183012 - RNA, 1401 nt, Artificial Sequence; identical to SEQ ID NO: 182987
  derived and/or modified sequence opt4 from neuraminidase__InfluenzaB__EPI826201

SEQ ID NO: 183013 - RNA, 1401 nt, Artificial Sequence; identical to SEQ ID NO: 182726
  derived and/or modified sequence opt4 from neuraminidase__InfluenzaB__EPI477398

SEQ ID NO: 183014 - RNA, 1401 nt, Artificial Sequence; identical to SEQ ID NO: 182726
  derived and/or modified sequence opt4 from neuraminidase__InfluenzaB__EPI492570

SEQ ID NO: 183015 - RNA, 1401 nt, Artificial Sequence; identical to SEQ ID NO: 182726
  derived and/or modified sequence opt4 from neuraminidase__InfluenzaB__EPI498339

SEQ ID NO: 183016 - RNA, 1401 nt, Artificial Sequence; identical to SEQ ID NO: 182947
  derived and/or modified sequence opt4 from neuraminidase__InfluenzaB__EPI538118

SEQ ID NO: 183017 - RNA, 1401 nt, Artificial Sequence; identical to SEQ ID NO: 182947
  derived and/or modified sequence opt4 from neuraminidase__InfluenzaB__EPI538124

SEQ ID NO: 183018 - RNA, 1401 nt, Artificial Sequence; identical to SEQ ID NO: 182947
  derived and/or modified sequence opt4 from neuraminidase__InfluenzaB__EPI556421

SEQ ID NO: 183019 - RNA, 1401 nt, Artificial Sequence; identical to SEQ ID NO: 182947
  derived and/or modified sequence opt4 from neuraminidase__InfluenzaB__EPI614609

SEQ ID NO: 183020 - RNA, 1401 nt, Artificial Sequence; identical to SEQ ID NO: 181191
  derived and/or modified sequence opt4 from neuraminidase__InfluenzaB__BAB32609

SEQ ID NO: 183021 - RNA, 1401 nt, Artificial Sequence; identical to SEQ ID NO: 181337
  derived and/or modified sequence opt4 from neuraminidase__InfluenzaB__EPI271544

SEQ ID NO: 183022 - RNA, 1401 nt, Artificial Sequence; identical to SEQ ID NO: 181337
  derived and/or modified sequence opt4 from neuraminidase__InfluenzaB__AFH57957

SEQ ID NO: 183023 - RNA, 1401 nt, Artificial Sequence; identical to SEQ ID NO: 181337
  derived and/or modified sequence opt4 from neuraminidase__InfluenzaB__EPI294881

SEQ ID NO: 183024 - RNA, 1401 nt, Artificial Sequence; identical to SEQ ID NO: 181192
  derived and/or modified sequence opt4 from neuraminidase__InfluenzaB__ABL77259

SEQ ID NO: 183025 - RNA, 1701 nt, Artificial Sequence
  derived and/or modified sequence opt5 from hemagglutinin__InfluenzaA__AAA16879
auggaggccaagcuguucgugcucuuuugcaccuucacaguccugaaagcugacacgaucuguguuggcuaccacgccaacaauagcaccgauacaguggacaccgugcuugaaaagaacgucacagugacccauuccguuaaucugcucgaggauucucacaacgggaaacugugcagccuuaauggaauugcgccccugcagcucggcaaguguaacguggcuggguggcugcugggaaauccugaaugcgaccuccugcuuacagccaacuccuggucuuauaucauugagaccagcaauuccgaaaacggcacguguuacccgggggaguuuaucgauuaugaggaacugagagagcaacucucuagcgucuccagcuucgaaaaauuugagauuuuccccaaggccucuuccuggccuaaucaugagaccacaaagggagugaccgcugccugcagcuacucuggcgcuuccagcuuuuaucggaaccugcuuuggaucaccaaaaagggcaccucuuaccccaaacuguccaagagcuauacgaauaacaaagggaaggaaguucucgugcuguggggaguccaccauccucccacaaccuccgagcagcagucucuguaccagaaugccgacgcguacgugagcgugggcuccagcaaguauaaccgcagauucacaccugaaaucgccgcucggccgaaaguccgcgggcaagccggaagaaugaacuacuauuggacccuccuggaucagggcgacaccauuacauuugaggcuacggggaaucuuaucgcccccugguacgcguucgcccugaacaagggaucugauuccggcauuaucaccagcgacgcuccuguucacaauugugauacacggugccagacaccccacggcgcccucaacucuagccugccuuuucagaaugugcaucccauuacaaucggggaauguccgaaauauauuaaguccaccaaacuucgcauggcuacgggacugagaaacgugccuucuauccaaagccggggccucuucggggccaucgccggauuuauugagggcggguggacaggaaugaucgacggcugguacggcuaucaccaucagaaugagcagggguccggauacgcugcggaucaaaagagcacccagaacgccauugacggcaucaccaauaaagucaacucugugauugaaaagaugaauacacaguucaccgcuguugggaaggaguucaacaaucuggaacgcagaaucgagaaccugaauaaaaagguggacgauggauuucucgacgucuggacauacaacgccgaacugcuugugcugcucgagaacgagcggacgcuggauuuccacgacuccaauguucgcaaccuuuaugaaaaagucaagagccagcugagaaauaacgccaaagagcucggcaaugggugcuuugaguucuaccacaagugugaugacgaaugcauggaacgggagaagaacggcaccuaugauuaccccaaauauucugaggaauccaagcugaaucgcgaggaaaucgacggagugaaacuggagagcaugggcguguaccaaauucucgcuaucuauuccacagucgccucuagccuggugcuucugguuucccucggggcgauuucuuuuuggaugugcagcaacggaucccugcaguguagaaucugcauuuga

SEQ ID NO: 183026 - RNA, 1701 nt, Artificial Sequence
  derived and/or modified sequence opt5 from hemagglutinin__InfluenzaA__AAA16880
auggaggccaagcuguucgugcucuuuugcaccuucacaguccugaaagcugacacgaucuguguuggcuaccacgccaacaauagcaccgauacaguggacaccgugcuugaaaagaacgucacagugacccauuccguuaaucugcucgaggauucucacaacgggaaacugugcagccuuaauggaauugcgccccugcagcucggcaaguguaacguggcuggguggcugcugggaaauccugaaugcgaccuccugcuuacagccaacuccuggucuuauaucauugagaccagcaauuccgaaaacggcacguguuacccgggggaguuuaucgauuaugaggaacugagagagcaacucucuagcgucuccagcuucgaaaaauuugagauuuuccccaaggccucuuccuggccuaaucaugagaccacaaagggagugaccgcugccugcagcuacucuggcgcuuccagcuuuuaucggaaccugcuuuggaucaccaaaaagggcaccucuuaccccacgcuguccaaaagcuauacaaauaacaaggggaaagaaguucucgugcuguggggaguccaccauccucccaccgugaaugagcagcagucccuguaccagaacgccgacgcguacgugucugucggcagcuccaaguauaaccgcagauucacaccugaaaucgccgcucggccgaagguucgcgggcaagccggaagaaugaauuaccacuggacccuccuggaucagggcgacaccauuacauuugaggcuacggggaaccuuaucgcccccugguaugcguucgcccugaauaaaggaagcgauucuggcauuaucaccuccgacgcuccugugcacaacugugauacacggugccagacaccccauggcgcccucaauagcucucugccuuuucagaacgugcaccccauuacaaucggggaauguccgaaguacgucaaaagcaccaaacuucgcauggcuacgggacugagaaaugugccuuccauucaaucucggggccucuucggggccaucgccggauuuaucgagggcggguggacaggaaugauugacggcugguauggcuaccaucaccagaacgagcaggggagcggauaugcugcggaucagaaauccacccaaaaugccaucgacggcauuaccaacaagguuaauagcgugaucgaaaagaugaacacaaaguucaccgcugucgggaaggaguucaauaaccuggaacgcagaauugagaaucugaacaaaaagguggacgauggauuucucgacguuuggacauacaacgccgaacugcuugugcugcucgagaaugagcggacgcuggauuuccacgacucuaacguccgcaaucuuuacgaaaaagugaagucccagcugagaaacaaugccaaagagcucggcaacgggugcuuugaguucuaucauaagugugaugacgaaugcaucgaaagcgucaagaauggcaccuacgauuaucccaaauacucugaggaguccaagcugaaccgggaagagaucgacggagugaaacuggaaagcaugggcguuuaucagauucucgcuaucuacuccacaguggccucuagccugguccuucuggugucccucggggcgauuucuuuuuggaugugcagcaauggaucccugcaaugucgcaucugcauuuga

SEQ ID NO: 183027 - RNA, 1689 nt, Artificial Sequence
  derived and/or modified sequence opt5 from hemagglutinin__InfluenzaA__AAA64362
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaaguaucugcucucuagcgucaagcauuucgaaaaagugaagauucugccuaaagaucgguggacacaacacaccacaaccggcggcucccgcgccugugccguuucugggaaccccagcuuuuucagaaauaugguguggcuuacgaagaaaggauccgacuacccugucgcuaagggcagcuauaacaauaccucuggggagcagaugcugaucauuuggggagugcaucacccgaacgaugagacagaacagcggacccucuaccagaauguuggcacauacguguccgucgggaccagcacgcugaacaagcgcucuacacccgagaucgccaccagaccuaaagugaauggacugggcucccggauggaauuuagcuggacacuccuggacaugugggauaccauuaacuucgagucuaccggcaaccuuaucgcucccgaauauggguuuaagaucuccaaacgcggaagcuccggcauuaugaagacagaggggacgcuggagaauugcgaaaccaaaugucaaacaccucucggagccaucaacaccacacugcccuuccacaaugugcauccgcuuaccauuggcgagugcccuagauacgucaagucugaaaaacugguucucgcgacggggcugcggaacgugccccagaucgagagccgcggacuguuuggcgccauugcuggcuucaucgaagggggauggcagggcaugguggacgggugguauggauaccaccauuccaaugaucagggcagcggguaugccgcugacaaggagucuacacaaaaggccuuugacggcaucaccaacaaagucaauuccgugauugagaagaugaacacccaguucgaagcgguuggaaaagaguuuagcaaucucgaaagacggcuggagaaccuuaauaagaaaauggaagauggcuuccuggacguguggacauacaacgccgagcuccugguccuuauggagaaugaacgcacccuggauuuccacgacucuaacgugaagaaucucuaugauaagguuagaaugcagcugcgggacaacgugaaagagcuggggaacggauguuuugaguucuaccacaagugcgaugacgaguguaugaauagcgucaaaaacggcacauacgauuauccuaaguacgaggaagaguccaaacucaauagaaacgaaaucaagggggugaagcugucuagcaugggagucuaucagauucuugcuaucuacgccacgguggcuggcucccugagccucgccauuaugauggccgggaucucuuuuuggaugugcuccaauggcagccugcaaugccgcaucuguauuuga

SEQ ID NO: 183028 - RNA, 1689 nt, Artificial Sequence
  derived and/or modified sequence opt5 from hemagglutinin__InfluenzaA__AAA64363
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaggaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauccugucgcuaagggcagcuacaauaacaccucuggggagcagaugcugaucauuuggggagugcaccacccgaaugacgagacagaacagcggacccucuaucagaacguuggcacauacguguccgucgggaccagcacgcugaauaagcgcucuacacccgauaucgccaccagaccuaaagugaacggacaaggcggccggauggaguuuuccuggacacugcucgacaugugggauaccauuaacuucgaaagcaccgggaaucugaucgcucccgaguacggauuuaagaucucuaaacgcggcuccagcgggauuaugaagacagaaggaacgcuuggcaacugcgagaccaaaugucagacaccucugggggccaucaauaccacacuccccuuccauaacgugcacccgcugaccauuggagagugcccuaaguaugucaaauccgaaaaacuuguucuggcgacgggccucagaaaugugccccagaucgagucucggggccuguuuggggccauugcuggauucaucgaaggcggguggcagggaaugguggacggcugguacggguaucaucacagcaacgaucaaggcuccggauacgccgcugacaaggagagcacacagaaagccuuugacggcaucaccaauaaggucaacucugugauugaaaagaucaauacccaguucgaggcgguugagaaggaauuuuccaaccuggagcgcagacucgaaaaucugaacaaaaagauggaggauggguuccuugacguguggacauauaaugccgaacugcucguccugauggagaacgagcggacccuugauuuccacgacagcucugugaagaaucuguacgauaaaguucgcaugcagcucagagacaacgugaaggaacugggaaacggcuguuuugaguucuaucauaaaugcgaugacgaauguaugaauagcgucaagaacgggacauacgauuacccuaaauaugaggaggaauccaagcugaaucggaacgagauuaagggagugaaacucucuagcaugggcaucuaccaaauucuggcuaucuaugccacggucgcugggucccuuagccuggccaucaugauggccggcauuucuuuuuggaugugcuccaauggaagccuccagugcagaaucuguauuuga

SEQ ID NO: 183029 - RNA, 1689 nt, Artificial Sequence
  derived and/or modified sequence opt5 from hemagglutinin__InfluenzaA__AAA64365
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauccugucgcuaagggcagcuacaauaacaccucuggggagcagaugcugaucauuuggggagugcaccacccgaaugacgagacagaacagcggacccucuaucagaacguuggcacauacguguccgucgggaccagcacgcugaauaagcgcucuacacccgauaucgccaccagaccuaaaguggacggacugggcucccggauggaguuuagcuggacacuccuggauaugugggacaccauuaacuucgaaucuaccggcaaccuuaucgcucccgaguacggguuuaagaucuccaaacgcggaagcuccggcauuaugaagacagaagggacgcugggaaauugcgagaccaaaugucaaacaccucucggcgccaucaacaccacacugcccuuccauaaugugcacccgcuuaccauuggggagugcccuaaguaugucaaaucugaaaagcugguucucgcgacgggacugagaaacgugccccagaucgagagccggggccuguuuggcgccauugcuggguucaucgaaggaggcuggcaggggaugguggauggaugguacggcuaucaucacuccaaugaccaggggagcggcuacgccgcugacaaggagucuacacaaaaagccuuugauggaaucaccaacaaggucaauuccgugauugagaaaaugaacacccaguucgaggcgguugagaaggaauuuagcaaucucgagcgcagacuggaaaaccuuaauaaaaagauggaggacggcuuccuggauguguggacauauaacgccgaacuccugguccuuauggagaaugagcggacccuggacuuccacgauucuaacgugaagaaucucuacaacaaaguucgcaugcagcugagagacaacgugaaggaacuggggaauggauguuuugaguucuaucauaaaugcgaugacgaauguaugaacagcgucaagaauggcacauacgauuacccuaaauaugaggaggaauccaagcucaaccggaaugagaucaagggggugaaacugucuagcaugggaauuuaccagauccuugcuauuuaugccacggucgcuggcucccugagccucgccaucaugauggccgggaucucuuuuuggaugugcuccaacggcagccugcaaugcagaauuuguaucuga

SEQ ID NO: 183030 - RNA, 1689 nt, Artificial Sequence
  derived and/or modified sequence opt5 from hemagglutinin__InfluenzaA__AAA64366
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaagaguccaacuauccugucgcuaagggaagcuacaauaacaccucuggcgagcagaugcugaucauuuggggagugcaccacccgaaugacgaaacagagcagcggacccucuaucagaacguugggacauacguguccgucggcaccagcacgcugaauaagcgcucuacacccgauaucgccaccagaccuaaagugaacgggcugggaucccggauggaauuuagcuggacacuccuggacaugugggauaccauuaacuucgagucuaccggcaaucuuaucgcucccgaauacggcuuuaagaucuccaaacgcgggagcuccggaauuaugaagacagagggcacgcuggagaacugcgaaaccaaaugucaaacaccucucggggccaucaauaccacacugcccuuccauaacgugcacccgcuuaccauuggagagugcccuaaguaugucaaaucugaaaagcugguucucgcgacgggccugagaaaugugccccagaucgagagccgggggcuguuuggagccauugcuggcuucaucgaaggcggguggcagggaaugguggacggcugguacggguaucaucacuccaacgaucagggaagcggcuacgccgcugacaaggagucuacacaaaaagccuuugacgggaucaccaauaaggucaacuccgugauugagaaaaugaauacccaguucgaagcgguuggcaaggaguuuagcaaccucgaacgcagacuggagaaucuuaacaaaaagauggaagauggauuccuggacguguggacauauaaugccgagcuccugguccuuauggagaacgaacggacccuggauuuccacgacucuaaugugaagaaccucuacgauaaaguucgcaugcagcugagagacaacgugaaggagcugggcaauggguguuuugaguucuaucauaaaugcgaugacgaguguaugaacagcgucaagaauggaacauacgauuacccuaaauaugaggaagaguccaagcucaaccggaaugaaaucaagggcgugaaacugucuagcaugggggucuaccagauucuugcuaucuaugccacgguggcuggaucccugagccucgccauuaugauggccggcaucucuuuuuggaugugcuccaacgggagccugcaaugcagaaucuguauuuga

SEQ ID NO: 183031 - RNA, 1701 nt, Artificial Sequence
  derived and/or modified sequence opt5 from hemagglutinin__InfluenzaA__AAA85781
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcucugcuugcaaaagaggaccugauaacggcuuuuucucccggcugaauuggcucuacaagagcgggucuaccuaucccguccaaaacgugacaaugccuaauaacgacaacuccgauaagcuguacauuuggggaguucaccauccgagcaccgacaaagagcagacgaaucuuuaugugcaggccucuggcaaggucacaguguccaccaaacgcagccagcaaacagugauccccaacgucggguccagaccuuggguucggggacugucuagccgcguguccauuuacuggaccaucgugaagcccggcgacauucucgucaucaauagcaacggcaaucugaucgcgccuagaggguacuauaaaaugcggaccggaaagucuuccauuaugcgcagcgaugcccccaucggcacauguucuagcgagugcauuacgccgaacggguccaucccuaaugacaagcccuuucagaacgugaauaaaauuaccuacggagcuuguccuaaguauguuaaacagaacacacugaagcucgccaccggcaugagaaaugugcccgaaaaacagauccgggggaucuucggagcuauugccggcuuuaucgagaacggcugggaagggaugauugauggaugguacggcuuccgccaccaaaauucugaggggacaggacaggcggccgaccuuaagagcacccaggcugccaucgaucaaauuaacggcaaacugaauagagucaucgagaagacgaacgaaaaguuucaccagaucgagaaagaguucuccgaaguggaagggcggauucaggaccuggagaaguauguugaggauacaaaaaucgaccucuggagcuacaacgcugaacugcuuguggcccuggagaaucagcauaccauugaucucaccgacucugaaaugaacaagcuguucgagaaaacacgcagacaacugcgggaaaaugccgaggauaugggcaacggaugcuuuaagaucuaucacaagugugacaaucccugcauuggcuccaucagaaacgggaccuacgaccaugaugucuaccgcgacgaggcucucaauaaccgguuccagauuaaaggaguggaacuuaagagcggcuauaaagauuggauccuguggaucucuuuugcgauuuccugcuuccugcucugugucgugcugcuuggguuuaucaugugggccugccagaagggaaauauuagauguaacaucugcauuuga

SEQ ID NO: 183032 - RNA, 1707 nt, Artificial Sequence
  derived and/or modified sequence opt5 from hemagglutinin__InfluenzaA__AAC14418
auggagagaaucgugcugcuccuggccaccgucagccuuguuaaguccgaccagauuugcaucggcuaccacgcuaacaauucuacagaacaaguggauacgauuauggagaaaaacgugaccgucacacaugcccaggacauccuggaacggacccacaaugggaagcucugugaucugaacggagugaaaccccuuauucugcgcgacugcagcguugcgggcuggcuccuggggaauccuaugugugaugaguucaucaacgugccggaaugguccuauaucgucgagaaggcuucucccgccaaugaccugugcuacccuggaaacuuuaaugauuaugaggaacucaaacaucugcuuagcagaauuaaccacuucgagaagauccagauuauccccaaguccucuuggagcaaucaugacgccuccagcggcgugucuuccgcuuguccuuaccuggggcggagcuccuuuuuccgcaacguuguguggcucauuaaaaagaacucuacauaucccaccaucaaaagaagcuacaauaauacaaaccaggaagaucugcuuguccuguggggcauucaccacccuaacgacgccgcugagcaaaccaagcucuaucagaauccgacgaccuacaucucugugggaacauccacccugaaccagcggcuggugcccgagaucgccacacgcccuaaagucaauggccagagcgggagaauggaauuuuucuggaccauucucaagcccaacgaugcgaucaauuuugaguccaacggaaauuucauugccccugaauacgcuuauaagaucguuaaaaagggcgacucuacgauuaugaaaagcgagcuggaauacgggaacugcaauacaaagugucaaacccccaugggagccaucaacuccagcaugccguuucauaauauccacccucuuacaauuggcgagugccccaaauaugugaagucuaaccggcuggugcucgcuaccgggcugcgcaaugccccucagagagagcggcgccggaaaaagagaggacuuuucggcgcgaucgccggcuuuauugaagggggauggcagggcauggucgaugggugguacggauaucaucacuccaacgagcagggcagcggguacgcugccgaccaagaaucuacccagaaggcuaucgacggagugacaaauaaaguuaacagcauuaucaacaagaugaauacgcaguucgaggccgugggccgcgaauuuaacaaucuggagagacggaucgagaaccucaauaaaaagauggaagauggcuuccuggacgucuggaccuauaacgccgagcugcucgugcugauggaaaaugagagaacacuugauuuccacgacuccaacguuaaaaaucuguacgauaaggugcgccuccaacugcgggacaacgcuaaggaacuugggaauggauguuuugaguucuaccauaaaugcgauaacgaguguauggaaucugucaagaauggcaccuaugacuacccccaguauagcgaggaagcgagacugaaccgcgaggagauuuccggggugaaacucgaaagcaugggaacauaccagauccugucuauuuauuccaccgucgccagcucucuggcucucgccaucaugguggccggccugucccuuuggaugugcagcaaugggucccugcagugccggauuuguaucuga

SEQ ID NO: 183033 - RNA, 1707 nt, Artificial Sequence
  derived and/or modified sequence opt5 from hemagglutinin__InfluenzaA__AAC40508
auggagagaaccgugcugcuccuggccacagucagccuuguuaaguccgaccagaucugcauuggcuaccacgcuaacaauucuacggaacaaguggauaccaucauggagaaaaacgugacagucacccaugcccaggacauucuggaacggacacacaaugggaagcucugugaucugaacggagugaaaccccuuauccugcgcgacugcagcguugcgggcuggcuccuggggaauccuaugugugaugaguucauuaacgugccggaaugguccuauaucgucgagaaggcuucucccgccaaugaccugugcuacccuggaaacuuuaaugauuaugaggaacucaaacaucugcuuagcagaaucaaccacuucgagaagauucagaucauucccaaguccucuuggagcaaucaugacgccuccagcggcgugucuuccgcuuguccuuaccuggggcggagcuccuuuuuccgcaacguuguguggcucaucaaaaagaacucugccuaucccaccauuaaaagaagcuacaauaauacaaaccaggaagaucugcuuguccuguggggagugcaccacccuaacgacgcugccgagcaaaccaagcucuaucagaauccgacgaccuacaucucugugggcacauccacccugaaccagcggcugguccccgagauugcgacacgcccuaaaguuaauggccagagcgggagaauggaauuuuucuggaccauccucaagcccaacgaugccaucaauuuugaguccaacggaaauuucauugcuccugaauacgccuauaagaucgugaaaaagggcgacucuacgauuaugaaaagcgagcuggaauacgggaacugcaauacaaagugucaaacccccaugggagcuaucaacuccagcaugccguuucauaauauucacccucuuacaaucggcgagugccccaaauaugugaagucuaaccggcugguccucgccaccgggcugcgcaauaccccucagagagagcggcgccggaaaaagagaggacuuuucggcgcgaucgccggcuuuauugaagggggauggcagggcaugguggaugggugguacggauaucaucacuccaacgagcagggcagcuguuacucugcugacaaggaaagcacacaaaaagccaucgacgggguuacgaauaaggugaacuccauuaucaacaaaaugaauacccaguucgaggcugucggacgcgaauuuaacaaucuggagagacggauugagaaccucaauaagaaaauggaagauggcuuccuggacguguggacauauaacgccgagcugcucguucugauggaaaaugagagaacccuugauuuccacgacucuaacgugaagaaucuguacgauaagguccgccuccagcugcgggacaacgccaaagaacuuggcaaugggugcuuugaguucuaccauaagugugauaacgagugcauggaaagcgugaaaaauggaacauaugacuacccccaauauuccgaggaagcuagacugaaccgcgaggagaucagcggcgucaagcucgaaucuauggggaccuaccagauccuguccauuuauagcacgguggcgucuucccuggcccucgcuaucaugguugccggacugagccuuuggaugugcuccaauggcucucugcagugucggauuugcaucuga

SEQ ID NO: 183034 - RNA, 1701 nt, Artificial Sequence
  derived and/or modified sequence opt5 from hemagglutinin__InfluenzaA__AAF87274
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaaaauagacacaacgggaaacuuuguaagcugaagggaguugcuccccuccaucugggcaaaugcaauaucgccggguggcugcucggaaacccugagugugaacugcuuuuuaccgccucuagcugguccuacauuguggagacgucuaauagcgauaacggaaccugcuauccgggggacuucaucaauuacgaagaacugcgggagcagcucuccucugucagcuccuuugaacgcuucgagauuuuucccaaggcuaacagcuggccuaaucacgaaacaaacagaggagugaccucugccugucccuaugcuggcgccaauuccuucuaccggaaccugaucuggcuuguuaagaaaggcaacagcuauccuaagcugucuaaauccuacaucaauaacaaggggaaagaggugcucguccuguggggcauucaucaucccccuacaagcaaugaucaacagucucuguaccagaacgcggacgccuauguguuugugggcuccagcaaguacaauaagaaauucaugccggagaucgcuacccgccccaaggucagagggcaggccggacggaugaacuauuacuggacgcucauugaaccuggcgauacaaucaccuuugaggcuacagggaaucugguugcgccccgcuaugccuucgccauggaaagaggauccggcucuggcauuaucauuagcgacaccccugugcacgauugcaacgcuaccugucaaacacccaaaggggccaucaauacgaaccuuccguuucagaauauccacccugugaccauuggagagugccccaaguacgucaaauccacacggcugcgcauggcuaccggccucagaaacaucccuagcauucagucucgggggcuguucggagccaucgccggcuuuauugaagggggauggacaggcaugaucgacggcugguauggguaccaccaucagaaugagcaaggauccggcuacgcugcggaucgcaagagcacccagaacgccaucgacgggauuacgaauaaagugaacucuguuaucgagaagaugaacacacaguucaccgcugugggaaaggaguucaaucaccuugagaaaagaauuaagaaccugaauaaaaaggucgaugacggcuuucucgacguguggaccuauaacgccgaacugcugguucuccuggagaaugaacggacacuugauuaccacgacagcaacgugaaaaaucuguaugagaagguccgcucccagcucagaaacaaugccaaggagaucgggaacggcuguuucgaauuuuaccauaaaugcgaugacaccuguauggagucuauuaagaauggaacauaugauuaccccaaauauagcgaagaggcuaagcugacgcgggaagagaucgacggcgugaaacuugaguccaccagaaucuaccaaauucuggccaucuacagcacaauugcgucuucccucguccugcuggugagccucggggcuaucucuuucuggaugugcuccaacggaagccugcagugccgcauuuguaucuga

SEQ ID NO: 183035 - RNA, 1701 nt, Artificial Sequence
  derived and/or modified sequence opt5 from hemagglutinin__InfluenzaA__AAF87275
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaaaauagacacaacgggaaacuuuguaagcugaagggaguugcuccccuccaucugggcaaaugcaauaucgccggguggcugcucggaaacccugagugugaacugcuuuuuaccgccucuagcugguccuacauuguggagacgucuaauagcgauaacggaaccugcuauccgggggacuucaucaauuacgaagaacugcgggagcagcucuccucugucagcuccuuugaacgcuucgagauuuuucccaaggcuaacagcuggccuaaucacgaaacaaacagaggagugaccucugccugucccuaugcuggcgccaauuccuucuaccggaaccugaucuggcuuguuaagaaaggcaacagcuauccuaagcugucuaaauccuacaucaauaacaaggggaaagaggugcucguccuguggggcauucaucaucccccuacaagcaaugaucaacagucucuguaccagaacgcggacgccuauguguuugugggcuccagcaaguacaauaagaaauucaugccggagaucgcuacccgccccaaggucagagggcaggccggacggaugaacuauuacuggacgcucauugaaccuggcgauacaaucaccuuugaggcuacagggaaucugguugcgccccgcuaugccuucgccauggaaagaggauccggcucuggcauuaucauuagcgacaccccugugcacgauugcaacgcuaccugucaaacacccaaaggggccaucaauacgaaccuuccguuucagaauauccacccugugaccauuggagagugccccaaguacgucaaauccacacggcugcgcauggcuaccggccucagaaacaucccuagcauucagucucgggggcuguucggagccaucgccggcuuuauugaagggggauggacaggcaugaucgacggcugguauggguaccaccaucagaaugagcaaggauccggcuacgcugcggaucgcaagagcacccagaacgccaucgacgggauuacgaauaaagugaacucuguuaucgagaagaugaacacacaguucaccgcugugggaaaggaguucaaucaccuugagaaaagaauugaaaaccugaauaagaaagucgaugacggcuuucucgacguguggaccuauaacgccgagcugcugguucuccuggaaaaugagcggacacuugauuaccacgacagcaacgugaagaaucuguaugagaaaguccgcucccagcucagaaacaaugccaaggaaaucgggaacggcuguuucgaguuuuaccauaagugcgaugacaccuguauggaaucuauuaaaaauggaacauaugauuaccccaaguauagcgaggaagcuaaacugacgcgggaggagaucgacggcgugaaacuugaauccaccagaaucuaccaaauucuggccaucuacagcacaauugcgucuucccucguccugcuggugagccucggggcuaucucuuucuggaugugcuccaacggaagccugcagugccgcauuuguaucuga

SEQ ID NO: 183036 - RNA, 1701 nt, Artificial Sequence
  derived and/or modified sequence opt5 from hemagglutinin__InfluenzaA__AAF87277
augaaggccauccugcucgugcugcuuuacaccuucacagcugccaacgcggacacgcugugcauuggcuaucacgcuaauaacagcaccgauacagucgacaccguucucgagaagaaugugacagugacccauuccgucaaccugcuugaagauagacacaaugggaagcuguguaaacuccggggaaucgcuccccugcaucugggcaagugcaacauugccggguggcuccugggaaauccugagugugaacuucuguuuacagccucuagcugguccuacaucguggagaccucuaacagcgacaauggcacgugcuauccgggggauuucauuaacuacgaagaacuccgcgagcagcuguccucuguuagcuccuuugaaagauucgagaucuuucccaaagccagcucuuggccugaccacgaaaccaaucggggagugacagcugccugucccuaugcgggcgccaacuccuucuaccgcaaucuuaucuggcuggucaagaagggcaacagcuauccuaaacucucuaaguccuacauuaauaacaaagagaaggaggugcugguucugugggggauccaucaucccccuaccagcacagaucaacagucucucuaccagaacgcugacgccuauguguuugucggauccagcaaauacaauaagaaguucaaaccggaaauugcuuccagacccaaggugcggggccaggccgggcgcauggauuauuacuggacccugguggagccuggagacacgaucacauuugaagcgaccggcaaccuugucguucccagauaugccuucgcuaugaaacgggggucuggaagcggcauuaucauuuccgauacaccugugcacgacugcaauaccaccugucaaacacccaagggcgccaucaacacgagccugccguuucagaauauccacccugugaccauuggggagugccccaaauacgucaagucuacaaaacuccgcauggcuaccggacugagaaacaucccuuccauucagagccggggccuuuucggggccaucgccggauuuauugaaggcggguggacaggaaugaucgauggcugguauggcuaccaccaucagaaugagcaagggucuggauacgcugcggaccgcaagagcacccagaacgccaucgacggcgugacgaauaagguuaacuccgugauugagaaaaugaauacacaguucaccgcugucgggaaggaguucaaccaccuggagaaaagaaucgaaaaucucaacaagaaaguggaugacggauuucuggauguuuggaccuauaaugccgagcugcucgugcugcuugaaaacgagcggacacuggacuaccacgauucuaacgucaagaaucucuaugagaaggugcgcagccagcugaaaaacaaugccaaggaaauuggcaacggguguuucgaguuuuaccauaaaugcgacgauaccuguauggaauccgucaagaauggcacauaugacuaccccaaauauagcgaggaaucuaaacuuaacagagaggagaucgauggagugaagcuggaauccacgcggauuuaccaaauccucgcuaucuacagcaccguugccucuucccugauucugcucgugagccugggcgcgaucuccuucuggaugugcucuaaugggagccuucagugcagaauuuguaucuga

SEQ ID NO: 183037 - RNA, 1701 nt, Artificial Sequence
  derived and/or modified sequence opt5 from hemagglutinin__InfluenzaA__AAF87278
augaaggccauccugcucgugcugcuuuacaccuucacagcugccaacgcggacacgcugugcauuggcuaucacgcuaauaacagcaccgauacagucgacaccguucucgagaagaaugugacagugacccauuccgucaaccugcuugaagauagacacaaugggaagcuguguaaacuccggggaaucgcuccccugcaucugggcaagugcaacauugccggguggcuccugggaaauccugagugugaacuucuguuuacagccucuagcugguccuacaucguggagaccucuaacagcgacaauggcacgugcuauccgggggauuucauuaacuacgaagaacuccgcgagcagcuguccucuguuagcuccuuugaaagauucgagaucuuucccaaagccagcucuuggccuaaucacgaaaccaaccggggagugacagcugccugucccuaugcgggcgccaauuccuucuaccgcaaccuuaucuggcuggucaagaagggcaauagcuauccuaaacucucuaaguccuacauuaacaacaaagagaaggaggugcugguucugugggggauccaucaucccccuaccagcacagaccaacagucucucuaccagaaugcugaugccuauguguuugucggauccagcaaauacaacaagaaguucaaaccggaaauugcuuccagacccaaggugcggggccaggccgggcgcauggacuauuacuggacccugguggagccuggagauacgaucacauuugaagcgaccggcaaucuugucguucccagauaugccuucgcuaugaaacgggggucuggaagcggcauuaucauuuccgacacaccugugcacgauugcaacaccaccugucaaacacccaagggcgccaucaauacgagccugccguuucagaacauccacccugugaccauuggggagugccccaaauacgucaagucuacaaaacuccgcauggcuaccggacugagaaauaucccuuccauucagagccggggccuuuucggggccaucgccggauuuauugaaggcggguggacaggaaugaucgacggcugguauggcuaccaccaucagaacgagcaagggucuggauacgcugcggaucgcaagagcacccagaaugccaucgacggcgugacgaacaagguuaauuccgugauugagaaaaugaacacacaguucaccgcugucgggaaggaguucaaucaccuggagaaaagaaucgaaaaccucaauaagaaaguggacgauggauuucuggacguuuggaccuauaacgccgagcugcucgugcugcuugaaaacgagcgggcccuggauuaccacgacucuaaugucaagaaccucuaugagaaggugcgcagccagcugaaaaauaacgcuaaggaaauuggcaauggguguuucgaguuuuaccauaaaugcgaugacacauguauggaauccgucaagaacggcaccuaugauuaccccaaauauagcgaggaaucuaaacuuaauagagaggagaucgacggagugaagcuggaauccacacggauuuaccaaauccucgccaucuacagcacgguugcgucuucccugauucugcucgugagccugggcgcuaucuccuucuggaugugcucuaacgggagccuucagugcagaauuuguaucuga

SEQ ID NO: 183038 - RNA, 1701 nt, Artificial Sequence
  derived and/or modified sequence opt5 from hemagglutinin__InfluenzaA__AAF87279
augaaggccauccugcucgugcugcuuuacaccuucacagcugccaacgcggacacgcugugcauuggcuaucacgcuaauaacagcaccgauacagucgacaccguucucgagaagaaugugacagugacccauuccgucaaccugcuugaagauagacacaaugggaagcuguguaaacuccggggaaucgcuccccugcaucugggcaagugcaacauugccggguggcuccugggaaauccugagugugaacuucuguuuacagccucuagcugguccuacaucguggagaccucuaacagcgacaauggcacgugcuauccgggggauuucauuaacuacgaagaacuccgcgagcagcuguccucuguuagcuccuuugaaagauucgagaucuuucccaaagccagcucuuggccuaaucacgaaaccaaccggggagugacagcugccugucccuaugcgggcgccaauuccuucuaccgcaaccuuaucuggcuggucaagaagggcaauagcuauccuaaacucucuaaguccuacauuaacaacaaagagaaggaggugcugguucugugggggauccaucaucccccuaccagcacagaccaacagucucucuaccagaaugcugaugccuauguguuugucggauccagcaaauacaacaagaaguucaaaccggaaauugcuuccagacccaaggugcggggccaggccgggcgcauggacuauuacuggacccugguggagccuggagauacgaucacauuugaagcgaccggcaaucuugucguucccagauaugccuucgcuaugaaacgggggucuggaagcggcauuaucauuuccgacacaccugugcacgauugcaacaccaccugucaaacacccaagggcgccaucaauacgagccugccguuucagaacauccacccugugaccauuggggagugccccaaauacgucaagucuacaaaacuccgcauggcuaccggacugagaaauaucccuuccauucagagccggggccuuuucggggccaucgccggauuuauugaaggcggguggacaggaaugaucgacggcugguauggcuaccaccaucagaacgagcaagggucuggauacgcugcggaucgcaagagcacccagaaugccaucgacggcgugacgaacaagguuaauuccgugauugagaaaaugaacacacaguucaccgcugucgggaaggaguucaaucaccuggagaaaagaaucgaaaaccucaauaagaaaguggacgauggauuucuggacguuuggaccuauaacgccgagcugcucgugcugcuugaaaacgagcggacacuggauuaccacgacucuaaugucaagaaccucuaugagaaggugcgcagccagcugaaaaauaacgccaaggaaauuggcaauggguguuucgaguuuuaccauaaaugcgaugacaccuguauggaauccgucaagaacggcacauaugauuaccccaaauauagcgaggaaucuaaacuuaauagagaggagaucgacggagugaagcuggaauccacgcggauuuaccaaauccucgcuaucuacagcaccguugccucuucccugauucugcucgugagccugggcgcgaucuccuucuggaugugcucuaacgggagccuucagugcagaauuuguaucuga

SEQ ID NO: 183039 - RNA, 1701 nt, Artificial Sequence
  derived and/or modified sequence opt5 from hemagglutinin__InfluenzaA__AAF87281
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauagacacaaugggaaacuuuguaagcugaagggaaucgcuccccuccaucugggcaaaugcaacauugccggguggcugcucggaaauccugagugugaacugcuuuuuaccgccucuagcugguccuacaucguugagacgucuaacagcgacaaugggaccugcuauccgggcgauuucauuaacuacgaggagcugcgggagcagcucuccucugugagcuccuuugaacgcuucgagaucuuucccaaggcuagcucuuggccuaaucacgaaacaaacagaggagucaccuccgccugucccuaugcuggcgccaauagcuucuaccggaaccugaucuggcuugugaagaaaggcaauucuuauccuaagcuguccaaaagcuacauuaacaacaaggggaaaaagguucucgugcuguggggaauccaucaucccccuacaucuaccgaccaacagucccuguaccagaaugcggaugccuaugucuuugugggcagcuccaaguacaacaaaaaguucaugccggagauugcuacgcgccccaaagugagagggcaggccggacggaugaauuauuacuggacacucaucgagccuggcgacaccauuacauuugaagcuaccgggaaccuggucguuccccgcuaugccuucgcgauggagagaggauacggcucuggcaucauuaucagcgauaccccugugcacgacugcaauacaacgugucaaacccccaagggggccaucaacacaucccuuccguuucagaauauucacccugugaccaucggagaaugccccaaauaugucaagagcacaaaacugcggauggcuaccggccuccgcaacauuccuucuauccaguccagagggcuguucggagccauugcuggcuuuaucgaagggggauggacgggcaugaucgauggcugguacggguaccaccaucagaaugaacaaggaagcggcuaugccgccgaccggaagucuacacagaacgcuauugaugggaucaccaauaaggugaacagcguuauugagaaaaugaauacccaguucacagcggugggaaaggaguucaaccaccuugaaaaacgcaucgagaaucugaacaagaaagucgacgacggcuuucucgauguguggaccuacaacgccgaacugcugguucuccuggagaaugaaagaacacuugacuaucacgauuccaacgugaagaaucuguacgagaaggucaaaucucagcucaagaacaaugcuaaagagauugggaacggcuguuucgaauuuuaucauaagugcgacgauacguguauggagagcgugaaaaauggaaccuacgacuaucccaaguacuccgaagaggccaagcugaaccgggaagagaucgauggcgucaaacuugagagcacacgcaucuaccaaauucuggccaucuauucuaccauugcuuccagccucgugcugcugguuucucucggggccaucuccuucuggaugugcagcaauggaucccugcagugcagaauuuguaucuga

SEQ ID NO: 183040 - RNA, 1701 nt, Artificial Sequence; identical to SEQ ID NO: 183038
  derived and/or modified sequence opt5 from hemagglutinin__InfluenzaA__AAF87282

SEQ ID NO: 183041 - RNA, 1701 nt, Artificial Sequence
  derived and/or modified sequence opt5 from hemagglutinin__InfluenzaA__AAF87283
augaaggccauccuggugguccuccuguacgcuuucaccacagccaacgcggacacgcuuugcauuggcuaucacgcuaauaacagcaccgauacaguugacaccgugcuggagaaaaaugugacagucacccauuccgugaaccuccuggaagauagacacaaugggaaacuuuguaagcugaagggaguugcuccccuccaucugggcaaaugcaacaucgccggguggcugcucggaaauccugagugugaacugcuuuuuacagccucuagcugguccuacauuguggagaccucuaacagcgacaauggcacgugcuauccgggggauuucaucaacuacgaagaacugcgggagcagcucuccucugucagcuccuuugaacgcuucgagauuuuucccaaggccagcucuuggccuaaucacgaaaccaacagaggagugacauccgcuugucccuauagcggcgccaauucuuucuaccggaaccugaucuggcuuguuaagaaaggcaauuccuauccuaagcugagcaaaucuuacaucaacaacaaggggaaagaggugcucguccuguggggcauucaucaucccccuaccuccacagaccaacagagccuguaccagaaugcggaugccuauguguuugugggauccucuaaguacaacaagaaauucaugccggagaucgcuacccgccccaaggucagagggcaggccggacggaugaauuauuacuggacgcucauugaaccuggcgacacaaucaccuuugaggcuacagggaaccugguugcgccccgcuaugccuucgccauggaaagaggaagcggcuccggcauuaucauuagcgauaccccuguguacgacugcaauaccgcuugucaaacacccaaaggggccaucaacacgucucuuccguuucagaauauccacccugugaccauuggagagugccccaaguaugucaaauccacaaagcugcggauggcuaccggccuccgcaacaucccuagcauucagucuagagggcuguucggagccaucgccggcuuuauugaagggggauggacaggcaugaucgauggcugguacggguaccaccaccagaaugagcaaggaagcggcuaugcucccgaccggaaauccacccagaacgcgaucgaugggauuacgaauaaggugaacucuguuaucgagaagaugaauacacaguucaccgccgugggaaaagaguucaaccaucuugagaagcgcauugaaaaucugaacaaaaaggucgacgacggcuuucucaacguguggaccuacaaugcugagcugcugguucuccuggaaaacgagagaacacuugauuaucacgacagcaaugugaaaaaccuguacgagaagguccggucccagcucaagaauaacgccaaagaaaucgggaauggcuguuucgaguuuuaucacaagugcgaugacaccuguauggaaagcgugaaaaacggaacauacgauuaucccaaguacucugaggaagcccgccugaauagagaggagauugacggcgucaaacuugaauccacgcggaucuaccaaauccuggcuauuuauagcaccaucgccucuucccucgugcugcugguuagccucggggcgauuuccuucuggaugugcucuaacggaagccugcagugcagaaucuguauuuga

SEQ ID NO: 183042 - RNA, 1701 nt, Artificial Sequence
  derived and/or modified sequence opt5 from hemagglutinin__InfluenzaA__AAF87284
augaaggccauccuggugguccuccuguacgcuuucaccacagccaacgcggacacgcuuugcauuggcuaucacgcuaauaacagcaccgauacaguugacaccgugcuggagaaaaaugugacagucacccauuccgugaaccuccuggaagauagacacaaugggaagcucuguaaacugaagggaguugcuccccuccaucugggcaaaugcaacaucgccggguggcugcucggaaauccugagugugaacugcuuuuuacagccucuagcugguccuacauuguggagaccucuaacagcgacaauggcacgugcuauccgggggauuucaucaacuacgaagaacugcgggagcagcucuccucugucagcuccuuugaacgcuucgagauuuuucccaaggccagcucuuggccuaaucacgaaaccaacagaggagugacauccgcuugucugcuuuucuggagcaagcaacugcuccagaaacugaauauggccggcaagaaaggcaacucuuaucccaagcuguccaaaagcuacaucaauaacaaggggaaggagguucucgugcuguggggaauccaucacccucccaccucuacagaccagcagucccuuuaucaaaacgcggaugccuacgucuuugugggcagcuccaaauacaauaagaaauucaugccugagauugcuacccggccgaaggugcgcgggcaggccggaagaaugaacuauuacuggacgcugaucgaacccggcgacacaauuaccuuugaggcuacagggaaucucgucgccccucgguaugcguucgccauggaacgcggaucuggcagcggcaucauuaucuccgauacccccguuuacgacugcaacaccgcuugucagacaccuaaaggggccauuaauacgagccugcccuuucagaacauccacccggugaccaucggagagugcccuaaguaugugaaaucuacaaaacuuagaauggcuaccggccugcggaauauucccuccauccaaagccgcgggcuuuucggagccauugccggcuuuaucgaagggggauggacaggcaugauugauggcugguacggguaucaucaccagaacgagcagggaucuggcuacgcugcggacagaaagagcacccagaaugccaucgaugggaucacgaacaaggucaauuccgugauugagaagaugaacacacaauucaccgcuguuggaaaagaguucaaucaucuggagaagcggaucgaaaaccugaauaaaaagguggacgacggcuuucucaacgucuggaccuacaacgccgagcugcuugugcugcucgaaaaugagcgcacacuggauuaucacgacucuaacguuaagaaucuuuacgagaaagugagaagccagcugaagaacaaugccaaagaaauugggaacggcuguuucgaguuuuaucacaagugcgaugacaccuguauggaauccgucaaaaauggaacauacgauuauccuaaguacagcgaggaagcucggcucaaccgcgaggagaucgacggcgugaagcuggaaucuacgagaauuuaucagauccuggccaucuacuccaccauugcgagcucucucguccugcuugugucccugggggcuaucagcuucuggaugugcuccaauggaucucuccaaugccggauuuguaucuga

SEQ ID NO: 183043 - RNA, 1701 nt, Artificial Sequence
  derived and/or modified sequence opt5 from hemagglutinin__InfluenzaA__AAG01749
augagcaccaucauugcccuguccuacauccucugccugguguucgcucagaaacuucccggcaacgacaauucuacagccacgcugugucucgggcaccaugcggucccuaacggaacccugguuaaaacaauuaccaaugaucaaaucgaggugacaaacgcuaccgaacuugugcagagcuccucuacaggcagaauuugcgacagcccgcaccggauccuggaugggaagaauuguacccucaucgacgcccugcugggagauccccauugcgacggcuuucagaacaaagagugggaucucuucgucgaacgcuccaaggccuauucuaauuguuacccuuaugacgugcccgauuacgcuagccugagaucccuuguugccagcucugggacgcuggaguuuaccaacgaaggauucaauuggacaggcguggcucaggacggcaccuccuaugccugcaaacgggggagcgucaaguccuuuuucucucgccucaacuggcugcacaaacuugaguacaaguauccugcgcugaaugugacaaugcccaacaaugauaaguuugacaaacucuacauuuggggaguucaucacccuagcaccgauucugaccaaacgucccuguacgugcaggccagcggcagagucacaguguccaccaagcggucucagcagacagugaucccgaacauugggagccgccccugggucagaggaaucuccagccggauuucuaucuauuggaccauuguuaaaccuggcgacauccugcucaucaauuccaccgggaaccugauugcuccccgcggauacuucaagaucagaagcggcaagucuagcauuaugcgguccgaugccccuaucgacaacuguaauucugagugcauuacacccaacggcagcaucccgaaugaaaaaccuuuucaaaacgugaaucgcaucacguauggggcuugucccagauacgugaagcagaacacccuuaaacuggccacaggaaugcggaaugucccugagaagcagacccgcggcauuuucggggcgaucgccggauuuauugaaaacggcugggaggggaugguggauggaugguauggcuucagacaccaaaauuccgagggcacagggcaggcugccgaccucaaaagcacccaggcugccaucaaccagauuaauggaaagcugaaccggcuuaucgaaaagacgaaugagaaguuucaucaaaucgaaaaggaguucucugaaguugagggccgcauucaggaucuggagaaauacguggaagacacaaagaucgaucucugguccuauaacgccgagcugcuggucgcucucgaaaaucagcacaccauugaccugaccgauagcgagaugaacaaacuuuucgaaagaacacggaagcagcugagagagaacgcggaggacauggggaauggaugcuuuaaaaucuaccauaagugugauaacgccugcauuggcucuauccgcaaugggaccuacgaccacgacguguaucgggaugaagcucucaacaauagauuccaaauuaagggcguugagcugaaauccggauacaaggacuggauccuuuggaucagcuuugccauuuccugcuuccugcucugugugguccugcugggcuuuaucaugugggccugccagaaagggaacauucgcuguaauaucugcauuuga

SEQ ID NO: 183044 - RNA, 1701 nt, Artificial Sequence
  derived and/or modified sequence opt5 from hemagglutinin__InfluenzaA__AAG01767
augaacaccaucauugcccugagcuacauccucugccugguguucgcucagaagcugcccggcaaugacaacuccacagccacgcugugucucgggcaccaugcggucccuaauggaacccugguuaaaacaauuaccaacgaucaaaucgaggugacaaaugcuaccgaacuugugcagucuagcuccacaggcagaauuugcgacucuccgcaccggauccuggaugggaagaacuguacccucaucgacgcccugcugggagauccccauugcgacggcuuucagaauaaagagugggaucucuucauugaacgcagcaaggccuauuccaacuguuacccuuaugacguccccgauuacucuagccugagaucccuuguggcuagcucugggacgcuggaguuuaccaaugaagacuucaacuggacaggaguugcccaggauggcggcuccuauagcugcaaacgggagucugugaaguccuuuuucagccgccucaauuggcugcacaaacuugaguacaaguauccugcucugaacgucaccaugcccaauaacgacaaguuugauaaacucuacaucuggggagugcaucacccuucuacagacuccgaacaaaccagccuguacguucaggccauugggagagugacggucuccacaaagucuagccagcagaccgugaucccgaauauuggcucccggcccugggugcgcgggaucagcucuagaauuuccaucuauuggacaaucgucaaaccuggagacauucugcucaucagcucuaccggcaaccugauugcgccccggggguacuucaagauccgcaacggaaagagcuccauuaugagaucugaugccccuaucgacaauuguuauagcgagugcaucacccccaacggcuccauuccgaaugauaaaccuuuucaaaacguuaaucggaucacauacggcgcuugucccaaguaugugaaacagaagacgcuuaaacuggccaccgggaugcgcaacgugccugaaaagcagacaagaggaauuuucggcgcuaucgccggguuuauugagaauggaugggagggcauggucgacgggugguacggauuccggcaccagaacagcgaaggcaccggccaagcggccgaucucaaaucuacacaggcugccaucgaccaggugaaugggaagcugaaccgccuuaucgagaagaccaaugaaaaauuucaucaaauugagaaggaguucuccgaaguugagggaagaauccaggaucuggaaaaauauguggaggacacgaagauugaucucuggagcuacaacgcugaacugcuggucgcccucgagaaucagcacacaaucgaccugaccgauucugaaaugaacaaacuuuucgagaagacccggaagcagcugagagagaaugccgaagacaugggcaacgggugcuuuaaaauuuaccauaagugugacaacgcuugcaucggauccauucgcaauggcacauaugaucacgacguguaccgggaugaggcgcucaacaauagauuccaaaucaaagggguugaacuuaagagcggcuauaaagacuggauccuuuggauuuccuuugccaucucuugcuuccugcucugugugguccugcugggauuuauuaugugggcuugccagaagggcaacauccgcuguaauauuugcaucuga

SEQ ID NO: 183045 - RNA, 1701 nt, Artificial Sequence
  derived and/or modified sequence opt5 from hemagglutinin__InfluenzaA__AAG01776
augaacaccaucauugcccugagcuacauccucugccugguguucgcucagaagcugcccggcaaugacaacuccacagccacgcugugucucgggcaccaugcggucccuaauggaacccugguuaaaacaauuaccaacgaucaaaucgaggugacaaaugcuaccgaacuugugcagucuagcuccacaggcagaauuugcgacucuccgcaccggauccuggaugggaagaacuguacccucaucgacgcccugcugggagauccccauugcgacggcuuucagaauaaagagugggaucucuucauugaacgcagcaaggccuauuccaacuguuacccuuaugacguccccgauuacucuagccugagaucccuuguggcuagcucugggacgcuggaguuuaccaaugaagacuucaacuggacaggaguugcccaggauggcggcuccuauagcugcaaacgggagucugugaaguccuuuuucagccgccucaauuggcugcacaaacuugaguacaaguauccugcucugaacgucaccaugcccaauaacgacaaguuugauaaacucuacaucuggggagugcaucacccuucuacagacuccgaacaaaccagccuguacguucaggccauugggagagugacggucuccacaaagucuagccagcagaccgugaucccgaauauuggcucccggcccugggugcgcgggaucagcucuagaauuuccaucuauuggacaaucgucaaaccuggagacauucugcucaucagcucuaccggcaaccugauugcgccccggggguacuucaagauccgcaacggaaagagcuccauuaugagaucugaugccccuaucgacaauuguuauagcgagugcaucacccccaacggcuccauuccgaaugauaaaccuuuucaaaacguuaaucggaucacauacggcgcuugucccaaguaugugaaacagaagacgcuuaaacuggccaccgggaugcgcaacgugccugaaaagcagacaagaggaauuuucggcgcuaucgccggguuuauugagaauggaugggagggcauggucgacgggugguacggauuccggcaccagaacagcgaaggcaccggccaagcggccgaucucaaaucuacacaggcugccaucgaccaggugaaugggaagcugaacuggcuuaucgagaagaccaaugaaaaauuucaucaaauugagaaggaguucuccgaaguugagggacgcauccaggaucuggaaaaauauguggaggacacgaagauugaucucuggagcuacaacgcugaacugcuggucgcccucgagaaucagcacacaaucgaccugaccgauucugaaaugaacaaacuuuucgagaagaccagaaagcagcugcgggagaaugccgaagacaugggcaacgggugcuuuaaaauuuaccauaagugugacaacgcuugcaucggauccauuagaaauggcacauaugaucacgacguguaccgcgaugaggcgcucaacaaucgguuccaaaucaaagggguugaacuuaagagcggcuauaaagacuggauccuuuggauuuccuuugccaucucuugcuuccugcucugugugguccugcugggauuuauuaugugggcuugccagaagggcaacaucagauguaauauuugcaucuga

SEQ ID NO: 183046 - RNA, 1701 nt, Artificial Sequence
  derived and/or modified sequence opt5 from hemagglutinin__InfluenzaA__AAG01785
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucauugaacgcagcaaagccuauuccaauuguuacccuuaugacguccccgauuacucuagccugagaucccuuguggcuagcucugggacgcuggaguuuaccaacgaagacuucaauuggacaggaguugcccaggauggcggcuccuauagcugcaagcgggagucugugaaguccuuuuucagccgccucaacuggcugcacaaacuugaguacaaguauccugcucugaaugucaccaugcccaacaaugacaaauuugauaagcucuacaucuggggagugcaucacccuucuacagacuccgaacaaaccagccuguacguucaggccauugggagagugacggucuccacaaaaucuagccagcagaccgugaucccgaacauuggcucccggcccugggugcgcgggaucagcucuagaauuuccaucuauuggacaaucgucaagccuggagacauucugcucaucagcucuaccggcaaucugauugcgccccggggguacuucaagauccgcaacggaaaaagcuccauuaugagaucugaugccccuaucgacaacuguuauagcgagugcaucacccccaauggcuccauuccgaacgauaagccuuuucaaaauguuaaccggaucacauacggcgcuugucccaaauaugugaagcagaaaacgcuuaagcuggccaccgggaugcgcaaugugccugaaaaacagacaagaggaauuuucggcgcuaucgccggguuuauugagaacggaugggagggcauggucgacgggugguacggauuccggcaccagaauagcgaaggcaccggccaagcggccgaucucaagucuacacaggcugccaucgaccaggugaacgggaagcugaaucgccuuaucgagaaaaccaacgaaaaguuucaucaaauugagaaagaguucuccgaaguugagggaagaauccaggaucuggaaaaguauguggaggacacgaaaauugaucucuggagcuacaaugcugaacugcuggucgcccucgagaaccagcacacaaucgaccugaccgauucugaaaugaauaaacuuuucgagaagacccggaagcagcugagagagaacgccgaagacaugggcaaugggugcuuuaagauuuaccauaaaugugacaacgcuugcaucggauccauucgcaacggcacauaugaucacgacguguaccgggaugaggcgcucaauaacagauuccaaaucaaggggguugaacugaaaagcggcuauaaggacuggauccuuuggauuuccuuugccaucucuugcuuccugcucugugugguccugcugggauuuauuaugugggcuugccagaagggcaauauccgcuguaacauuugcaucuga

SEQ ID NO: 183047 - RNA, 1701 nt, Artificial Sequence
  derived and/or modified sequence opt5 from hemagglutinin__InfluenzaA__AAK52911
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggaugggaaaaauuguacccucaucgacgcccugcugggagauccccauugcgacggcuuucagaacaaggagugggaucucuucgucgaacggagcacggccuauuccaauuguuacccuuaugacgugcccgauuacgcuucucugcgcagccuuguugccuccagcgggacccuggaguuuacaaaagaaggauucaacuggaccggcguggcucaagacggcacaucuuaugccugcaagagaggguccgucaagagcuuuuucucucggcucaauuggcugcacaaacuugaguacaaguauccugcgcugaacgugaccaugcccaauaacgauaaauuugacaagcucuacauuuggggaguucaucacccuuccacggauagcgaccagacaucucuguacgugcaggccuccggccgcgucaccgugagcacaaaaagaucccagcaaaccgugaucccgaauauugggucucggcccuggguccgcggaguuagcuccagaaucagcauuuauuggaccaucgugaagccuggcgacauucugcucaucaacucuacagggaaucugaucgcuccccggggauacuucaagauucgcuccggcaaaagcucuaucaugagaagcgaugccccuauugacaacuguaacuccgagugcaucacgcccaauggcucuauuccgaacgauaagccuuuucagaaugugaaccggaucaccuauggggcuuguccccgcuacgucaaacagaauacacuuaagcuggccaccggaaugagaaacgugccugaaaaacagacacggggcaucuucggggcgauugccggauuuaucgagaauggcugggaagggaugguugacggaugguauggcuuccgccaccaaaacagcgagggcaccgggcaggcugccgaucucaaguccacgcaggcugccauuaaucaaaucaacggaaaacugaauagacuuauugagaagacaaacgaaaaguuucaucagaucgagaaagaguucagcgaaguggaaggccggauccaggaccuggagaaguacgucgaggauaccaaaauugaccucuggucuuauaaugccgaacugcugguggcucucgagaaccagcacaccaucgaucugacagacuccgaaaugaauaaacuuuucgagagaacccgcaagcaacugcgggaaaacgcggaggauauggggaacggaugcuuuaagauuuaccauaagugugacaaugccugcaucggcagcauuagaaacgggacauacgaccacgauguuuaucgcgacgaggcucucaauaaccgguuccagaucaaaggcguggaacugaagucuggauacaaagauuggauucuuuggaucuccuuugccaucagcugcuuccugcucugugucgugcugcugggcuuuauuaugugggccugccagaaggggaauaucagauguaacauuugcaucuga

SEQ ID NO: 183048 - RNA, 1701 nt, Artificial Sequence
  derived and/or modified sequence opt5 from hemagglutinin__InfluenzaA__AAK52912
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcacgaaagccuauagcaauuguuacccuuaugacgugcccgauuacgcuucccugagaucucuuguugccagcuccgggacccuggaguuuacaaacgaaggauucaauuggaccggcguggcucagaacggcacaagcuaugccugcaagcgggggucugucaaguccuuuuucagccgccucaauuggcugcacaaacuugaguacaaguauccugcgcugaacgugaccaugcccaauaacgacaaauuugauaagcucuacauuuggggaguucaucacccuucuacggacuccgaucaaacaagccuguacgugcaggccucuggcagagucaccguguccacaaaacggagccagcagaccgugaucccgaauauugggucccgccccugggucagaggaguuucuagccggaucuccauuuauuggaccaucgugaagccuggcgacauucugcucaucaacagcacagggaaccugaucgcuccccgcggauacuucaagauuagaucuggcaaauccagcaucaugcggucugacgccccuauuggcaauuguaacagcgagugcaucacgcccaauggguccauuccgaacgauaagccuuuucaaaaugugaaccgcaucaccuauggagcuugucccagauacgucaaacagaauacacuuaagcuggccaccggcaugcggaacgugccugaaaaacagacacgcgggaucuucggagcgauugccggcuuuaucgagaaugggugggaaggaaugguugacggcugguauggcuucagacaccagaacucugaggggaccggacaagcugccgaucucaagagcacgcaggcugccauuaaucagaucaacggcaaacugaaucggcuuauugagaagacaaacgaaaaguuucaucaaaucgagaaagaguucuccgaaguggaagggagaauccaggaccuggagaaguacgucgaggauaccaaaauugaccucuggagcuauaaugccgaacugcugguggcucucgagaaccagcacaccaucgaucugacagacucugaaaugaacaagcuguucgagcgcacccggaaacagcugagagaaaaugcggaggauaugggaaacggcugcuuuaagauuuaccauaagugugacaaugccugcaucggguccauucgcaacggcacauacgaucacgacguuuaucgggacgaggcucucaauaacagauuccaaaucaaaggaguggaacuuaagagcggcuacaaagauuggauucuuuggaucucuuuugccaucuccugcuuccugcucugugucgugcugcugggguuuauuaugugggccugccagaagggaaauauccgcuguaacauuugcaucuga

SEQ ID NO: 183049 - RNA, 1701 nt, Artificial Sequence
  derived and/or modified sequence opt5 from hemagglutinin__InfluenzaA__AAK71687
augaaggccauccuggugguccuccuguacaccuucacaacggcuaacgccgacacccuuugcauuggcuaucacgcgaauaacagcacagauaccguugacacagugcuggagaagaaugugaccgucacacauuccgugaaccuccuggaagauagacacaaugggaaacuuuguaagcugcggggaguugcuccccuccaucugggcaagugcaacaucgccggguggcugcucggaaauccugagugugaaucucuguuuaccgccagcuccuggucuuacauuguggagacgagcaacuccgacaauggaaccugcuauccgggggauuucaucaacuacgaagaacuucgcgagcagcugucuagcgucuccagcuuugaaagauucgagauuuuucccgaaacaucuuccuggccuaaucacgacaccaaccggggagugacagcugccuguccccaugcuggcgccaauagcuucuaucgcaaccucaucuggcuggcgaaaaagggcgauucuuacccuaaacuuuccaagagcuauaucaauaacaaggggaaagagguucuggugcucuggggcauucaccaucccccuaccucugccgaccaacagucccuguaccagaacgcugaugccuacgucuuugugggcagcuccagauauucuaagaaauucaagccggagaucgcuacgcggcccaaggugcgcgggcaggccggaagaaugaauuacuauuggacacuggucgaaccuggcgacaaaauuaccuuugaggcgacagggaaccucguugugccccgguacgccuucgcuaugaagcgcaauagcgaauccggaaucauuaucagcgauauuucugugcacgacugcaacaccaccugucaaacaccuaaaggcgccaucaauacgucccugcccuuucagaacauccacccggucaccauuggcgagugcccuaaguaugugaaaagcacaaaacuuagaauggcuaccgggcugcggaauguucccucuauccagagccgcggacucuucggcgccauugccggguuuaucgaaggaggcuggacagggaugauugauggaugguacggcuaucaucaccagaacgagcaaggcuccggguacgcugcggaccugaagucuacccagaaugccaucgacggaaucacgaacaaggugaauagcgucauugagaagaugaacacacaguucaccgugguuggcaaagaguucaaucaccuugagaagagaaucgaaaaccugaauaaaaagguggaugacggguuucucgauauuuggaccuacaacgcugagcugcugguccuccuggaaaacgagcggacacuugacuaucaugauuccaaugugaaaaaccuguacgagaagguccgcagccagcucaagaauaacgccaaagaaaucggaaauggcuguuucgaguuuuaucacaagugcgacgauaccuguauggaaucugugaaaaacgggacauacgacuauccuaaguacuccgaggaagccaaacugaauagagaggagauugauggcguuaaacuugaaagcacgcggaucuaucaaauccuggcuauuuacucuaccguggccuccagccucguccuggugguuucccugggaacaaucucuuucuggaugugcagcaacggcucccuccagugcagaauuuguaucuga

SEQ ID NO: 183050 - RNA, 1707 nt, Artificial Sequence
  derived and/or modified sequence opt5 from hemagglutinin__InfluenzaA__AAS65618
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaaguuucccuuggcgugagcucugccuguccuuaccaggggaaauccagcuucuuucgcaacgucguguggcugaucaagaaaaauucuaccuaucccacaauuaagagauccuacaacaauaccaaccaagaggaccuccuggugcuuuggggaauccaccacccuaaugaugccgcugagcagacaaagcuguaucagaacccgaccacguacaucagcgucggcaccucuacacucaaccagcggcugguuccccgcauugccaccagauccaaagugaauggccaaagcgggcggauggaguucuuuuggacaauccugaagccuaacgacgcuauuaauuucgaauccaacggaaauuuuaucgcccccgaauacgcguauaaaauugugaagaaaggcgauucuaccaucaugaaaagcgagcucgaauacgggaacugcaauacgaaaugucagacaccuaugggagccaucaacuccagcaugcccuuccauaauauucacccgcugaccaucggcgagugcccuaaguaugucaagucuaaccgccuugugcuggcuacagggcucagaaauagcccccagcgggagcgcagacggaaaaagcgcggacuguuuggcgccauugcuggcuucaucgaagggggauggcagggcaugguugacgggugguacggauaucaucacuccaacgagcaaggcucuggguacgccgcggccaaagaaagcacccagaaggcuauugacggagugaccaauaaagucaacuccaucaucgauaagaugaauacacaguuugaggccgugggcagagaguucaacaaccuugaacggcgcauugagaaucugaacaagaaaauggaagacggcuuccucgauguuuggacguauaaugcugagcugcuggugcucauggaaaacgagagaacccuggacuuucacgauucuaaugucaagaaccuuuacgacaaagugcggcugcaacucaaggauaaugccaaagaacuggggaacggauguuucgaguuuuaccauaagugcgacaaugaguguauggaaagcgucagaaacggcacauaugauuacccucaguauuccgaggaagcccgccuuaagcgggaggagaucagcggggugaaacuggaaucuauuggaaucuaccagauucucuccaucuauagcaccguugcuucuucccuggcgcuggccauuaugguggcuggccucagccuguggaugugcuccaaugggucucuucagugcagaaucuguaucuga

SEQ ID NO: 183051 - RNA, 1704 nt, Artificial Sequence
  derived and/or modified sequence opt5 from hemagglutinin__InfluenzaA__AAT38819
augaacacccagauccuggccuucauugcuugcaugcucaucggcacaaagggggacaaaauuugucugggacaccaugccguggcgaauggcacgaaggucaacacccuuacagagagagggaucgaaguugugaaugcuaccgagacaguggaaaccgucaacauuaaaaagaucugcacacaaggaaaacggcccaccgaucugggccagugugggcuccugggaacgcuuaucggcccuccgcagugcgaccaguuucuggaguucgaugccaaucucauuaucgaacgcagagagggcaccgacguguguuaccccgggaaguuuacaaacgaggaaagccugcggcaaauucugcgcggauccggcgggaucgauaaggagucuaugggauucaccuauagcggcauuagaacaaauggggccaccuccgcuugccggcgcucuggaagcuccuuuuacgccgaaaugaaauggcuccugucuaacagcgacaaugcugccuucccucagaugacgaaguccuauagaaacccccggaauaaaccugcgcuuaucauuuggggcguucaccauagcggcucugccacagagcagaccaagcuguacggguccggaaacaaacucaucacagugggcagcucuaaguaucagcaauccuuuacccccagcccuggggcucgcccgcaggucaauggacagucuggcagaaucgauuuccacuggcugcuucuggaccccaacgauaccgugacauuuacguucaauggggccuuuauugcuccugaccgggccuccuucuuucgcggagagagccucggcguucaguccgaugugccccuggacucuggcugugaaggggauugcuuccauagcggaggcaccaucgucuccagccugccuuuccaaaacauuaaccccagaacaguggggaaguguccgcgguacgugaaacagaccucucuccugcuugcgacaggaaugcgcaaugucccugagaaccccaagcaggccuaucaaaaacagaugaccagaggccuguuuggggcuaucgccggcuucauugaaaauggaugggagggccucaucgacgggugguacggauuucggcaccagaacgcucagggcgaagggacggccgccgacuacaaguccacacaaagcgcuaucgaucagauuaccggaaaacugaauagacuuaucgacaagaccaaccagcaguucgagcugauugauaaugaguuuucugaaaucgagcaacagauuggcaacguuaucaauuggacacgcgacagcaugaccgaagugugguccuauaacgcggagcuccugguggccauggaaaaucagcacacaaucgaucuggcugacucugagaugaacaaacucuacgagcgggucagaaagcagcugcgcgaaaaugccgaggaagaugggacgggcugcuucgagauuuuucauaagugugacgaucaaugcauggaaagcauccggaacaauaccuaugaccacacacaguacagaaccgagucccuucagaaccgcauucagaucgauccugugaaacugagcucuggauauaaggacauuauccucugguucuccuuuggcgccagcugcuuccugcuucuggcuauugccauggggcucguuuuuaucuguaucaaaaacggaaauaugcggugcacaauuuguaucuga

SEQ ID NO: 183052 - RNA, 1707 nt, Artificial Sequence
  derived and/or modified sequence opt5 from hemagglutinin__InfluenzaA__AAV32636
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccaaaguuaauggccaaagcgggcggauggaguucuuuuggacaauccugaagccuaacgacgccauuaauuucgaauccaacggaaauuuuaucgcgcccgaauacgccuauaaaauugugaagaaaggcgauucuaccaucaugaaaagcgagcucgaauacgggaacugcaauacgaaaugucagacaccuaugggagcuaucaacuccagcaugcccuuccauaauauucacccgcugaccaucggcgagugcccuaaguaugugaagucuaaccgccuuguccuggccacagggcucagaaauagcccccagcgggagcgcagacggaaaaagcgcggacuguuuggcgcuauugccggcuucaucgaagggggauggcagggcaugguggacgggugguacggauaucaucacuccaacgagcaaggcucuggguacgcggccgacaaagaaagcacccagaaggcuauugauggaguuaccaauaaagugaacuccaucaucgacaagaugaauacacaguuugaggccgucggcagagaguucaacaaccuugaacggcgcauugagaaucugaacaagaaaauggaagauggcuuccucgacguguggacguauaaugcugagcugcugguucucauggaaaacgagagaacccuggauuuucacgacucuaaugugaagaaccuuuacgauaaaguccggcugcaacucagagacaaugccaaggaacuggggaacggauguuucgaguuuuaccauaaaugcgauaaugaguguauggaaagcgugcgcaacggcacauaugacuacccucaguauuccgaggaagcccggcuuaagagagaggagaucagcggggucaagcuggaaucuauuggaaucuaccagauucucuccaucuauagcaccguggcuucuucccuggcgcuggccauuaugguugcuggccucagccuguggaugugcuccaaugggucucuucagugccgcaucuguaucuga

SEQ ID NO: 183053 - RNA, 1707 nt, Artificial Sequence; identical to SEQ ID NO: 183052
  derived and/or modified sequence opt5 from hemagglutinin__InfluenzaA__AAV34704

SEQ ID NO: 183054 - RNA, 1707 nt, Artificial Sequence
  derived and/or modified sequence opt5 from hemagglutinin__InfluenzaA__AAV65826
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuggaggcauccaccacccuaaugaugcugccgagcagacaaagcuguaucagaacccgaccacguacaucagcgugggcaccucuacacucaaccagcggcuggucccccgcauugcuaccagauccaaaguuaaugggcaaagcggacggauggaguucuuuuggacaauccugaagccuaacgacgccauuaauuucgaauccaacggcaauuuuaucgcgcccgaauacgccuauaaaauugugaagaaaggggauucuaccaucaugaaaagcgagcucgaauacggaaacugcaauacgaaaugucagacaccuaugggcgcuaucaacuccagcaugcccuuccauaauauucacccgcugaccaucggggagugcccuaaguaugugaagucuaaccgccuuguccuggccacaggacucagaaauagcccccagcgggagcgcagacggaaaaagcgcggccuguuuggcgcuauugccggguucaucgaaggaggcuggcaggggaugguggacggaugguacggcuaucaucacuccaacgagcaagggucuggauacgcggccgacaaagaaagcacccagaaggcuauugauggcguuaccaauaaagugaacuccaucaucgacaagaugaauacacaguuugaggccgucggcagagaguucaacaaccuugaacggcgcauugagaaucugaacaagaaaauggaagauggguuccucgacguguggacguauaaugcugagcugcugguucucauggaaaacgagagaacccuggauuuucacgacucuaaugugaagaaccuuuacgauaaaguccggcugcaacucagagacaaugccaaggaacugggaaacggcuguuucgaguuuuaccauaaaugcgauaaugaguguauggaaagcgugcgcaacgggacauaugacuacccucaguauuccgaggaagcccggcuuaagagagaggagaucagcggagucaagcuggaaucuauuggcaucuaccagauucucuccaucuauagcaccguggcuucuucccuggcgcuggccauuaugguugcugggcucagccuguggaugugcuccaauggcucucuucagugccgcaucuguaucuga

SEQ ID NO: 183055 - RNA, 1701 nt, Artificial Sequence
  derived and/or modified sequence opt5 from hemagglutinin__InfluenzaA__AAX11505
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcgagcgcagaucuaacaaguccuuuuucagccggcugaauuggcucacacaucugaaguauaaauacccugcccuuaacgucaccaugcccaauaacgagaaguuugacaaacuguauaucuggggagugcaccauccugggacggauucugaccagauuucccucuacgcgcaggccagcggccgcaucacaguuuccaccaagagaucucaacagacagugauuccgaacaucgggagccggccccgcgucagagauguguccagccggauuucuaucuacuggaccaucgugaaaccuggagacauucugcugaucaauuccaccggcaaccucauugcuccccgcggguauuucaagaucagaagcggaaagucuagcauuaugcgguccgacgccccuaucggcaaauguaauucugaaugcaucacacccaacggcagcauuccgaaugauaagccuuuucagaacgucaaucgcaucacguacggggcuugucccagauauguuaaacagaacacccugaaacuugccacaggaaugcggaaugugccugagaaacaaacccgcggcauuuucggggcgaucgccggauuuauugaaaacggcugggaggggaugguggacggaugguacggcuucagacaccagaauagcgagggcacagggcaggcugccgaucugaaguccacccaagcugccaucaaccagaucaauggaaaacucaaccggcugauuggcaagacgaaugaaaaguuucaccagaucgagaaagaguucucugaagucgaagggcgcauucaggaccuugagaaguauguggaggauacaaaaaucgaccugugguccuacaacgccgaacuccugguugcucuggagaaccaacauaccauugaucucaccgacagcgaaaugaauaagcuguucgagagaacaaagaagcagcuucgggaaaacgcggaggauaugggaaauggcugcuuuaagaucuaucacaaaugugacaacgccugcauugggucuaucagaaauggcaccuacgaucaugacguguaccgcgacgaggcucugaacaaucgguuccagaucaagggagucgaacucaaauccggcuauaaggauuggauucuguggaucagcuuugccauuuccugcuuccuucuguguguggcccuccugggguuuaucaugugggcuugccagaaaggaaacauuagaugugacaucugcaucuga

SEQ ID NO: 183056 - RNA, 1701 nt, Artificial Sequence
  derived and/or modified sequence opt5 from hemagglutinin__InfluenzaA__AAX11525
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggauggaugguacggcuucagacaccagaacuccgagggcacagggcaggcugccgaccugaaaagcacccaagcugccaucaaucagaucaacggaaagcucaaucggcugauuggcaagacgaacgagaaauuucaccagaucgaaaaggaguucucugaagucgaggggcgcauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagaagcagcuucgggagaaugcggaagacaugggaaacggcugcuuuaaaaucuaucacaagugugauaaugccugcauugggucuaucagaaacggcaccuacgaccaugacguguaccgcgaugaggcucugaauaaccgguuccagaucaaaggagucgagcucaaguccggcuauaaagacuggauucuguggaucagcuuugccauuuccugcuuccuucuguguguggcccuccugggguuuaucaugugggcuugccagaagggaaauauuagauguaacaucugcaucuga

SEQ ID NO: 183057 - RNA, 1701 nt, Artificial Sequence; identical to SEQ ID NO: 183056
  derived and/or modified sequence opt5 from hemagglutinin__InfluenzaA__AAX11535

SEQ ID NO: 183058 - RNA, 1701 nt, Artificial Sequence; identical to SEQ ID NO: 183056
  derived and/or modified sequence opt5 from hemagglutinin__InfluenzaA__AAX11545

SEQ ID NO: 183059 - RNA, 1701 nt, Artificial Sequence; identical to SEQ ID NO: 183055
  derived and/or modified sequence opt5 from hemagglutinin__InfluenzaA__AAX11555

SEQ ID NO: 183060 - RNA, 1701 nt, Artificial Sequence; identical to SEQ ID NO: 183056
  derived and/or modified sequence opt5 from hemagglutinin__InfluenzaA__AAX11565

SEQ ID NO: 183061 - RNA, 1701 nt, Artificial Sequence
  derived and/or modified sequence opt5 from hemagglutinin__InfluenzaA__AAX11585
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacaacgaucagaucagccucuacgcgcaggccucuggccgcauuacaguuuccaccaaaagaagccaacagacagugaucccgaacauugggucccggccccgcgucagagacgugucuagccagaucuccaucuacuggaccauugugaagccuggagacauccugcugauuaauagcaccggcaaccucaucgcuccccggggguauuucaagauucgcucuggaaaauccagcaucaugagaucugaugccccuaucggcaaguguaauagcgagugcauuacacccaacggcuccaucccgaaugacaaaccuuuucagaacgucaaucggauuacguacggggcuuguccccgcuauguuaagcaaaacacccugaaacuugccacaggaaugagaaaugugccugaaaagcagacccggggcaucuucggggcgauugccggauuuaucgagaacggcugggaagggaugguggauggaugguacggcuuccgccaccaaaauucugagggcacagggcaggcugccgaccugaaaagcacccaggcugccaucaaccagauuaauggaaagcucaacagacugaucggcaagacgaaugagaaauuucaccagauugaaaaggaguucuccgaagucgaggggcggauccaagaucuugaaaaauauguggaggacacaaagauugaucuguggagcuacaacgccgagcuccugguugcucuggaaaaccagcauaccaucgaccucaccgauucugagaugaauaaacuguucgaaagaacaaagaagcagcuucgcgagaacgcggaagacaugggaaauggcugcuuuaaaauuuaucacaagugugauaacgccugcaucggguccauccggaauggcaccuacgaccaugacguguacagagaugaggcucugaacaaucgcuuccagauuaaaggagucgagcucaagagcggcuauaaagacuggauccuguggauuucuuuugccaucuccugcuuccuucuguguguggcccuccugggguuuauuaugugggcuugccaaaagggaaacauccgguguaauaucugcauuuga

SEQ ID NO: 183062 - RNA, 1701 nt, Artificial Sequence; identical to SEQ ID NO: 183056
  derived and/or modified sequence opt5 from hemagglutinin__InfluenzaA__AAX11605

SEQ ID NO: 183063 - RNA, 1701 nt, Artificial Sequence; identical to SEQ ID NO: 183056
  derived and/or modified sequence opt5 from hemagglutinin__InfluenzaA__AAX11615

SEQ ID NO: 183064 - RNA, 1701 nt, Artificial Sequence
  derived and/or modified sequence opt5 from hemagglutinin__InfluenzaA__AAX11625
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggauccggccccugggugcgcggggucagcucuagaauuuccaucuacuggaccauuguuaaaccuggagacauccugcucaucaacagcacaggcaaucugauugcuccccggggguauuucaagauccgcucuggaaagagcuccauuaugagaucugacgccccuaucggcaaauguaacagcgaaugcauuacccccaauggcuccaucccgaacgauaagccuuuucagaaugugaaccggaucaccuacggggcuuguccccgcuaugugaaacagaauacacuuaagcuggccacgggaaugagaaacgucccugagaaacaagcgcggggcauuuucggggccaucgcuggauuuauugaaaauggcugggaggggaugauggacggaugguacggcuuccgccaccagaacagcgagggcaccgggcaggccgcugaucucaagucuacacaagccgccaucaaucagauuaacggaaaacugaauagacuuaucgaaaagaccaacgagaaguuucaucagaucgaaaaagaguucuccgaaguggagggccggauucaggaccuggagaaguauguugaagauacaaaaaucgaccucuggagcuacaaugcugagcugcugguggcgcucgaaaaccaacacaccauugaucugacggacucugagaugaacaaacuuuucgaaagaacaaagaagcagcugcgcgagaaugccgaggauauggggaacggaugcuuuaagaucuaucauaaaugugacaaugcuugcauuggcuccauccggaacgggaccuacgaucacgacgucuacagagacgaagcccucaauaaccgcuuccagauuaagggcguggagcugaaaagcggauauaaggauuggauccuuuggaucuccuuugccauuucuugcuuccugcucuguaucguucugcugggcuuuauuaugugggcuugccagaaagggaauauccgguguaacauuugcaucuga

SEQ ID NO: 183065 - RNA, 1701 nt, Artificial Sequence; identical to SEQ ID NO: 183056
  derived and/or modified sequence opt5 from hemagglutinin__InfluenzaA__AAX12731

SEQ ID NO: 183066 - RNA, 1701 nt, Artificial Sequence
  derived and/or modified sequence opt5 from hemagglutinin__InfluenzaA__AAX12741
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggauggaugguacggcuucagacaccagaacuccgagggcacagggcaggcugccgaccugaaaagcacccaagcugccaucaaucagaucaacggaaagcucaaucggcugauuggcaagacgaacgagaaauuucaccagaucgaaaaggaguucucugaagucgaggggcgcauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagaagcagcuucgggagaaugcggaagacaugggaaacggcugcuuuaaaaucuaucacaagugugauaaugccugcauugggucuaucagaaacggcaccuacgaccaugacguguaccgcgaugaggcucugaauaaccgguuccagaucaaaggagucgagcucaaguccggcuauaaagacuggauucuguggaucagcuuugccacauccugcuuccuucuguguguggcccuccugggguuuauuaugugggcuugccagaagggaaauaucagauguaacauuugcaucuga

SEQ ID NO: 183067 - RNA, 1701 nt, Artificial Sequence; identical to SEQ ID NO: 183056
  derived and/or modified sequence opt5 from hemagglutinin__InfluenzaA__AAX12751

SEQ ID NO: 183068 - RNA, 1701 nt, Artificial Sequence
  derived and/or modified sequence opt5 from hemagglutinin__InfluenzaA__AAX12761
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacuccgagggcacagggcaggccgcugaucucaagagcacccaagccgcuaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcccucgaaaaccaacacacgauugaucugacagacagcgagaugaacaaacuuuucgaaagaaccaagaagcagcugcgggagaaugcugaggauauggggaacggaugcuuuaagaucuaucauaaaugugacaaugucugcauuggcucuaucagaaacgggaccuacgaucacgacguguaccgcgacgaagcgcucaauaaccgguuccagauuaagggcguugagcugaaauccggauauaaggauuggauccuuuggaucagcuuugccauuuccugcuuccugcucuguaucgugcugcugggcuuuauuaugugggcuugccagaaagggaauaucagauguaacauuugcaucuga

SEQ ID NO: 183069 - RNA, 1701 nt, Artificial Sequence
  derived and/or modified sequence opt5 from hemagglutinin__InfluenzaA__AAX12791
augaagaccaucauugcccugagcuacauccucugccugguguucgcucagaaacuucccggcaacgacaauuccauggccacacugugucucgggcaccaugcggucccuaacggaacgcugguuaagaccauuacaaaugaucaaaucgaggugaccaacgcuacagaacuugugcagucuagcuccaccggcagaauuugcgacucuccgcaccagauccuggauggggagaauuguacacucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacccuggaauuuaacaaugagucuuucaacuggacgggagucgcccaaaauggcaccuccagcgcuugcaaaagacggucugacaaguccuuuuucagccgccucaacuggcugcaccagcuuaaguauaaauacccugcccugaaugugacaaugcccaacaaugagaaguuugauaaacucuauauuuggggcguucaucacccugggaccgacucugaucagaucucccuguacgcgcaggccagcggaagagugacagucuccaccaagcggucucaacagacggugauuccgaacaucggcagcgggcccugggugcgcggagucuccagcagaauuucuaucuacuggacaauuguuaaaccuggcgacauccugcucaucaacuccaccgggaaucugauugcuccccggggauauuucaagauccgcagcggcaagucuagcauuaugagauccgacgccccuaucgauaaauguaacucugaaugcauuacacccaauggcagcaucccgaacgacaagccuuuucagaaugugaaccggaucaccuacgggcuuuguccccgcuaugugaaacagaauacccugaagcucgcuacaggaaugagaaacgucccugagaaacaaacgcggggcauuuucggggccaucgcgggauuuauugaaaauggcugggaggggaugauggauggaugguacggcuuccgccaccagaacuccgagggcaccgggcaggccgcugaccugaaaagcacacaagccgcuaucaaucagauuaacggaaaacuuaauagacugaucgaaaagaccaacgagaaguuucaucagaucgaaaaagaguucucugaaguggagggccggauucaggaucucgagaaguauguugaagacacaaaaaucgaucugugguccuacaaugccgagcugcucguggcccuggaaaaccaacacaccauugaccuuacggauagcgagaugaacaagcuguucgaaagaacaaagaagcagcuccgcgagaaugcugaggacauggggaacggaugcuuuaagaucuaucauaaaugugauaaugcgugcauuggcucuauccggaacgggaccuacgaccacgacgucuacagagaugaagcccugaauaaccgcuuccagauuaagggcguggagcuuaaauccggauauaaggacuggauccuguggaucagcuuugcuauuuccugcuuccuccuguguaucguucugcucggcuuuauuaugugggccugccagaaagggaauauccgguguaacauuugcaucuga

SEQ ID NO: 183070 - RNA, 1701 nt, Artificial Sequence
  derived and/or modified sequence opt5 from hemagglutinin__InfluenzaA__AAX12801
augaagaccaucauugcccugagcuacauccucugccugguguucgcucagaaauuucccggcaacgacaauuccacagccacgcuuugucuggggcaccaugcggucccuaacggaacccucguuaagacaauuaccaaugaucaaaucgaggugacaaacgcuaccgaacuggugcagucuagcuccacagacagaauuugcgauucuccgcaccagauccuugacggcgagaauuguacccugaucgaugcccuccugggggacccccauugcgauggauuccagaacaaagaaugggaccuguuugucgagcggagcaaggccuauuccaauuguuacccuuaugaugugcccgacuacguuucucuccgcagccugguggcuuccagcggcacgcuugaguucaacaaugaaucuuuuaacuggaccggggucgcccaaaauggaacauccagcgcuugcaaaagacggucugauaaguccuucuuuagccgccugaacuggcuccaccagcugaaguauaaauacccugcccuuaaugugaccaugcccaacaaugagaaguucgacaaacuguauauuuggggcguucaucacccuggcacagauucugaccagaucucccucuacgcgcaggccagcgggagagugaccgucuccacgaagcggucucaacagacagugauuccgaacaucggaagccgccccugggugagaggcgucuccagccggauuucuaucuacuggaccauuguuaaaccuggggacauccugcugaucaacuccacaggaaaucucauugcuccccgcggcuauuuuaagaucagaagcgggaagucuagcauuaugcgguccgaugccccuaucggaaaauguaacucugaaugcauuacccccaauggcagcaucccgaacgacaagccuuuccagaaugugaaccgcaucaccuacggcgcuugucccagauaugugaaacagaauacacugaagcuggccacggggaugcggaacgucccugagaaacaaacccgcggaauuuuuggcgcgaucgccggguucauugaaaauggaugggagggcaugauggaugggugguacggauuuagacaccagaacuccgagggcacaggccaggcugccgaccuuaagagcacccaagcugccaucaaucagauuaacgggaaacucaaucggcugaucgaaaagacaaacgagaaguuccaucagaucgaaaaagaguucucugaaguggagggacgcauucaggaucuugagaaguauguugaagacaccaaaaucgaucugugguccuacaaugccgagcuccugguggcucuggaaaaccaacacacgauugaccucacagauagcgagaugaacaagcuguuugaaagaaccaaaaagcagcuucgggagaaugcggaggacaugggcaacgggugcuucaagaucuaucauaaaugugauaaugccugcauuggaucuaucagaaacggcaccuacgaccacgacgucuaccgcgaugaagcucugaauaaccgguuucagauuaaggggguggagcucaaauccggcuauaaggacuggauccuguggaucagcuucgccauuuccugcuuucuucuguguaucguucuccugggauucauuaugugggccugccagaaaggcaauaucagauguaacauuugcaucuga

SEQ ID NO: 183071 - RNA, 1701 nt, Artificial Sequence
  derived and/or modified sequence opt5 from hemagglutinin__InfluenzaA__AAX12811
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggaucccgccccugggugagaggcgucagcucucggauuuccaucuacuggaccauuguuaaaccuggggacauccugcucaucaacagcacaggaaaucugauugcuccccgcggcuauuucaagaucagaucuggaaagagcuccauuaugcggucugacgccccuaucgggaaauguaacagcgaaugcauuacccccaauggcuccaucccgaacgauaagccuuuucagaaugugaaccgcaucaccuacggcgcuugucccagauaugugaaacagaauacacuuaagcuggccacggggaugcggaacgucccugagaaacaaacccgcggaauuuucggcgcgaucgccggguuuauugaaaauggaugggagggcaugauggacgggugguacggauucagacaccagaacagcgagggcacaggccaggcugccgaucucaagucuacccaagcugccaucaaucagauuaacgggaaacugaaucggcuuaucgaaaagacaaacgagaaguuucaucagaucgaaaaagaguucuccgaaguggagggacgcauucaggaccuggagaaguauguugaagauaccaaaaucgaccucuggagcuacaaugccgagcugcugguggcucucgaaaaccaacacacgauugaucugacagacucugagaugaacaaacuuuucgaaagaaccaagaagcagcugcgggagaaugcggaggauaugggcaacgggugcuuuaagaucuaucauaaaugugacaaugccugcauuggauccaucagaaacggcaccuacgaucacgacgucuaccgcgacgaagcucucaauaaccgguuccagauuaaggggguggagcugaaaagcggcuauaaggauuggauccuuuggaucuccuuugccauuucuugcuuccugcucuguaucguucugcugggauuuauuaugugggccugccagaaaggcaauaucagauguaacauuugcaucuga

SEQ ID NO: 183072 - RNA, 1701 nt, Artificial Sequence
  derived and/or modified sequence opt5 from hemagglutinin__InfluenzaA__AAX34061
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucgacuggaccggagugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggcgugcaccauccugggacggacucugaucagauuucccucuacgcgcaggccagcggacgcaucacaguuuccaccaaaagaucucaacagacagugauuccgaacaucggcagccggccccgcgucagagacguguccagccggauuucuaucuacuggaccaucgugaagccuggggacauucugcugaucaacuccaccggaaaucucauugcuccccgcggcuauuucaagaucagaagcgggaaaucuagcauuaugcgguccgaugccccuaucggaaaguguaacucugaaugcaucacacccaauggcagcauuccgaacgacaaaccuuuucagaaugucaaccgcaucacguacggcgcuugucccagauauauuaagcagaauacccugaaacuugccacagggaugcggaacguuccugagaagcaaacccgcggaaucuucggcgcgauugccggguuuaucgaaaauggaugggagggcaugguggaugggugguacggauucagacaccagaacuccgagggcacaggccaggcugccgaccugaaaagcacccaagcugccaucaaucagauuaacgggaagcucaaucggcugaucggaaagacgaacgaaaaauuucaccagauugagaaggaguucucugaaguggaaggcagaauccaggaucuugagaaauaugucgaggacacaaagauugaucugugguccuacaaugccgaacuccugguggcucuggagaaccaacauaccaucgaccucaccgauagcgaaaugaacaaacuguucgagcgcacaaagaagcagcuucgggaaaaugcggaggacauggggaacggaugcuuuaaaauuuaucacaagugugauaaugccugcaucggcucuaucagaaacgggaccuacgaccaugacguuuaccgcgaugaggcucugaauaaccgguuccagauuaaaggcguggaacucaaguccggauauaaagacuggauccuguggauuagcuuugccaucuccugcuuccuucugugugucgcccuccugggcuuuauuaugugggcuugccagaaggggaauaucagauguaacaucugcauuuga

SEQ ID NO: 183073 - RNA, 1701 nt, Artificial Sequence
  derived and/or modified sequence opt5 from hemagglutinin__InfluenzaA__AAX35821
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaaauccuuuuucagcagacugaauuggcucacacaucugaaguauaaauacccugcccuuaacgucaccaugcccaauaacgagaaguuugacaaacuguauaucuggggagugcaccauccugggacggauaacgaccagauuucucucuacgcgcaggccuccggccggaucacaguuagcaccaagcgcucccaacagacagugauuccgaauaucgggucuagaccccggguccgcgaugugagcuccagaauuagcaucuacuggaccaucgugaagccuggagacauucugcugaucaacucuaccggcaaucucauugcuccccggggguauuucaaaauccgcuccggaaagagcucuauuaugagaagcgacgccccuaucggcaaauguaacuccgagugcaucacacccaauggcucuauuccgaacgauaagccuuuucagaaugucaaccggaucacguacggggcuuguccccgcuauguuaaacagaauacccugaaacuugccacaggaaugagaaacgugccugaacggcaaacccgcggcauuuucggggcgaucgccggauuuauugagaauggcugggaagggaugguggacggaugguacggcuucagacaccagaacagcgagggcacagggcaggcugccgaucugaaguccacccaagcugccaucaaucagaucaacggaaagcucaaucggcugauuggcaagacgaacgagaaauuucaccagaucgaaaaggaguucagcgaagucgaggggcgcauucaggaccuugaaaaauauguggaggauacaaagaucgaccuguggucuuacaacgccgagcuccugguugcucuggaaaaucaacauaccauugaucucaccgacuccgagaugaacaaacuguucgaaagaacaaagaagcagcuucgggagaaugcggaagauaugggaaacggcugcuuuaaaaucuaucacaagugugacaaugccugcauugggagcaucagaaacggcaccuacgaucaugacguguaccgcgacgaggcucugaauaaccgguuccagaucaaaggagucgagcucaagucuggcuauaaagauuggauucuguggaucuccuuugccauuagcugcuuccuucuguguguggcccuccugggguuuaucaugugggcuugccagaagggaaauauuagauguaacaucugcaucuga

SEQ ID NO: 183074 - RNA, 1701 nt, Artificial Sequence; identical to SEQ ID NO: 183055
  derived and/or modified sequence opt5 from hemagglutinin__InfluenzaA__AAX35831

SEQ ID NO: 183075 - RNA, 1701 nt, Artificial Sequence
  derived and/or modified sequence opt5 from hemagglutinin__InfluenzaA__AAX35851
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacuccgagggcacagggcaggccgcugaucucaagagcacccaagccgcuaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcccucgaaaaccaacacacgauugaucugacagacagcgagaugaacaaacuuuucgaaagaaccaagaagcagcugcgggagaaugcugaggauauggggaacggaugcuuuaagaucuaucauaaaugugacaaugcgugcauuggcucuaucagaaacgggaccuacgaucacgacgucuaccgcgacgaagcccucaauaaccgguuccagauuaagggcguggagcugaaauccggauauaaggauuggauccuuuggaucagcuuugcuauuuccugcuuccugcucuguaucguucugcugggcuuuauuaugugggccugccagaaagggaauaucagauguaacauuugcaucuga

SEQ ID NO: 183076 - RNA, 1701 nt, Artificial Sequence
  derived and/or modified sequence opt5 from hemagglutinin__InfluenzaA__AAX35861
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagaauuaccgugucuacgaagcggagccaacagacagucaucccgaacauuggauccggccccugggugcgcggggugagcucuagaaucuccauuuacuggaccaucgucaaaccuggagacauccugcucauuaacagcacaggcaaucugaucgcuccccggggguauuucaagauucgcucuggaaagagcuccaucaugagaucugacgccccuauuggcaaauguaacagcgaaugcaucacccccaauggcuccaucccgaacgauaagccuuuucagaauguuaaccggauuaccuacggggcuuguccccgcuaugugaaacagaauacacuuaagcuggccacgggaaugagaaacgugccugagaaacaaacccggggcaucuucggggcgauugccggauuuaucgaaaauggcugggaggggaugauggacggaugguacggcuuccgccaccagaacagcgagggcacagggcaggcugccgaucucaagucuacccaagcugccauuaaucagaucaacggaaaacugaauagacuuaucgaaaagacaaacgagaaguuucaucagauugaaaaagaguucuccgaagucgagggccggauccaggaccuggagaaguauguggaagauaccaaaauugaccucuggagcuacaaugccgagcugcugguugcucucgaaaaccaacacacgaucgaucugacagacucugagaugaacaaacuuuucgaaagaaccaagaagcagcugcgcgagaaugcggaggauauggggaacggaugcuuuaagauuuaucauaaaugugacaaugccugcaucggcuccauucggaacgggaccuacgaucacgacguguacagagacgaagcucucaauaaccgcuuccagaucaagggcgucgagcugaaaagcggauauaaggauuggauccuuuggauuuccuuugccaucucuugcuuccugcucuguauugugcugcugggcuuuaucaugugggccugccagaaagggaauauucgguguaacaucugcaucuga

SEQ ID NO: 183077 - RNA, 1701 nt, Artificial Sequence
  derived and/or modified sequence opt5 from hemagglutinin__InfluenzaA__AAX35871
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccgccucuagaauuugcgacagcccgcaccagauccuggauggcgagaauuguacacucaucgacgcccugcugggggauccccauugcgacggauuucagaacaaagaaugggaucucuucgucgagcgguccaaggcuuauucuaauuguuacccuuaugacgugcccgauuacguuagccugcgcucccuuguggccagcucuggcacccuggaauuuaacaaugaguccuucaacuggacgggggucgcucaaaauggaaccagcuuugccugcaaaagacggucugacaaguccuucuuuagccgccucaacuggcugcaccagcuuaaguauaaauacccugcgcugaaugugacaaugcccaacaaugagaaguucgauaaacucuauauuuggggcguucaucacccuggcaccgacucugaucagaucucccuguacgcccaggcuagcgggagagugacagucuccaccaagcggucucaacagacggugauuccgaacaucggaagcggccccugggugcgcggggucuccagcagaauuucuaucuacuggacaauuguuaaaccuggagacauccugcucaucaacuccaccggcaaucugauugcuccccggggguauuuuaagauccgcagcggaaagucuagcauuaugagauccgacgccccuaucggcaaauguaacucugaaugcauuacacccaauggcagcaucccgaacgauaagccuuuccagaaugugaaccggaucaccuacggggccuguccccgcuaugugaaacagaauacccuuaagcuggcgacaggaaugagaaacgucccugagaaacaaacgcggggcauuuuuggggccaucgcuggauucauugaaaauggcugggaggggaugauggacggaugguacggcuuucgccaccagaacuccgagggcaccgggcaggccgcugaucucaagagcacacaagccgccaucaaucagauuaacggaaaacugaauagacuuaucgaaaagaccaacgagaaguuccaucagaucgaaaaagaguucucugaaguggagggccggauucaggaccuggagaaguauguugaagauacaaaaaucgaccucugguccuacaaugcugagcugcugguggcgcucgaaaaccaacacaccauugaucugacggacagcgagaugaacaaacuuuuugaaagaacaaagaagcagcugcgcgagaaugccgaggauauggggaacggaugcuucaagaucuaucauaaaugugacaaugcuugcauuggcucuauccggaacgggaccuacgaucacgacgucuacagagacgaagcccucaauaaccgcuuucagauuaagggcguggagcugaaauccggauauaaggauuggauccuuuggaucagcuucgccauuuccugcuuucugcucuguaucguucugcugggcuucauuaugugggcuugccagaaagggaauauccgguguaacauuugcaucuga

SEQ ID NO: 183078 - RNA, 1701 nt, Artificial Sequence; identical to SEQ ID NO: 183071
  derived and/or modified sequence opt5 from hemagglutinin__InfluenzaA__AAX38237

SEQ ID NO: 183079 - RNA, 1701 nt, Artificial Sequence
  derived and/or modified sequence opt5 from hemagglutinin__InfluenzaA__AAX47515
augaaggccaucauugcucugagcuacauccucugccugguguucgcccagaaacuucccggcaacgacaauuccaccgcgacacugugucucgggcaccaugcugucccuaacggaacgcugguuaagaccauuacaaaugaucaaaucgaggugaccaacgccacagaacuugugcagucuagcuccaccggcagaauuugcgacucuccgcaccagauccuggauggggagaauuguacacucaucgacgcccugcugggagauccccauugcgacggcuuucagaacaaagaaugggaucucuucgucgagcggagcaaggcuuauuccaauuguuacccuuaugacgugcccgauuacguuucucugcgcagccuuguggccuccagcgggacccuggaauuuaacaaugagucuuucaacuggacgggagucgcucaaaauggcaccuccagcgccugcaaaagacggucugacaaguccuuuuucagccgccucaacuggcugcaccagcuuaaguauaaauacccugcgcugaaugugacaaugcccaacaaugagaaguuugauaaacucuauauuuggggcguucaucacccugggaccgacucugaucagaucucccuguacgcccaggcuagcggaagagugacagucuccaccaagcggucucaacagacggugauuccgaacaucggcagccgccccugggugagaggggucuccagccggauuucuaucuacuggacaauuguuaaaccuggagacauccugcucaucaacuccaccggcaaucugauugcccccagaggguauuucaagaucagaagcggaaagucuagcauuaugcgguccgacgcuccuaucggcaaauguaacucugaaugcauuacacccaauggcagcaucccgaacgauaagccuuuucagaaugugaaccgcaucaccuacggggccugucccagauaugugaaacagaauacccuuaagcuggcgacaggaaugcggaacgucccugagaaacaaacgcgcggcauuuucggggccaucgcuggauuuauugaaaauggcugggaggggaugauggacggaugguacggcuucagacaccagaacuccgagggcaccgggcaggccgcugaucucaagagcacacaagccgccaucaaucagauuaacggaaaacugaaucggcuuaucgaaaagaccaacgagaaguuucaucagaucgaaaaagaguucucugaaguggagggccgcauucaggaccuggagaaguauguugaagauacaaaaaucgaccucugguccuacaaugcugagcugcugguggcgcucgaaaaccaacacaccauugaucugacggacagcgagaugaacaaacuuuucgaacgcacaaagaagcagcugcgggagaaugccgaggauauggggaacggaugcuuuaagaucuaucauaaaugugacaaugcuugcauuggcucuaucagaaacgggaccuacgaucacgacgucuaccgcgacgaagcccucaauaaccgguuccagauuaagggcguggagcugaaauccggauauaaggauuggauccuuuggaucagcuuugccauuuccugcuuccugcucuguaucguucugcugggcuuuauuaugugggcuugccagaaagggaauaucagauguaacauuugcaucuga

SEQ ID NO: 183080 - RNA, 1701 nt, Artificial Sequence
  derived and/or modified sequence opt5 from hemagglutinin__InfluenzaA__AAX47525
augaagaccaucauugcccugagcuacauccucugccugguguucgcucagaaacuucccggcaacgacaauuccacagccacgcuguguauggggcaccaugcggucccuaacggaacccucguuaagacaauuaccaaugaucaaaucgaggugacaaacgcuaccgaacuggugcagucuagcuccacaggcagaauuugcgacucuccgcaccagauccuugauggggagaauuguacccugaucgacgcccuccugggagauccccauugcgacggcuuucagaacaaagaaugggaucuguucgucgagcggagcaaggccuauuccaauuguuacccuuaugacgugcccgauuacguuucucuccgcagccugguggcuuccagcgggacgcuugaauuuaacaaugagucuuucaacuggaccggagucgcccaaaauggcacauccagcgcuugcaaaagacggucuaacaaguccuuuuucagccgccugaauuggcuccaccagcugaaguauaaauacccugcccuuaacgugaccaugcccaauaacgagaaguuugacaaacuguauauuuggggcguucaucacccugauacagacucuaaccagaucucccucuacgcgcaggccagcgggagagugaccgucuccacgaagcggucucaacagacagugauuccgaauaucggaagcggccccugggugcgcggggucuccagcagaauuucuaucuacuggaccauuguuaaaccuggagauauccugcugaucaacuccacaggcaaucucauugcuccccggggguauuucaagauccgcagcggaaagucuagcauuaugagauccgacgccccuaucggcaaauguaacucugaaugcauuacccccaauggcagcaucccgaacgacaagccuuuucagaaugugaaccggaucaccuacggggcuuguccccgcuaugugaaacagaauacacugaagcuggccacgggaaugagaaacgucccugagaaacaaacccggggcauuuucggggcgaucgccggauuuauugaaaauggcugggaggggaugauggauggaugguacggcuuccgccaccagaacuccgagggcacagggcaggcugccgaccuuaagagcacccaagcugccaucaaucagauuaacggaaaacucaauagacugaucgaaaagacaaacgagaaguuucaucagaucgaaaaagaguucucugaaguggagggccggauucaggaucuugagaaguauguugaagacaccaaaaucgaucugugguccuacaacgccgagcuccugguggcucuggaaaaucaacacacgauugaccucacagauagcgagaugaacaagcuguucgaaagaaccaaaaagcagcuucgcgagaaugcggaggacauggggaacggaugcuuuaagaucuaucauaaaugugauaaugccugcauuggcucuauccggaacgggaccuacgaccacgaugucuacagagacgaagcucugaauaaccgcuuccagauuaagggcguggagcucaaauccggauauaaggacuggauccuguggaucagcuuugccauuuccugcuuccuucuguguaucguucuccugggcuuuauuaugugggccugccagaaagggaauauccgguguaacauuugcaucuga

SEQ ID NO: 183081 - RNA, 1701 nt, Artificial Sequence; identical to SEQ ID NO: 183071
  derived and/or modified sequence opt5 from hemagglutinin__InfluenzaA__AAX47535

SEQ ID NO: 183082 - RNA, 1701 nt, Artificial Sequence; identical to SEQ ID NO: 183055
  derived and/or modified sequence opt5 from hemagglutinin__InfluenzaA__AAX56380

SEQ ID NO: 183083 - RNA, 1701 nt, Artificial Sequence; identical to SEQ ID NO: 183055
  derived and/or modified sequence opt5 from hemagglutinin__InfluenzaA__AAX56390

SEQ ID NO: 183084 - RNA, 1701 nt, Artificial Sequence
  derived and/or modified sequence opt5 from hemagglutinin__InfluenzaA__AAX56400
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcgagcgcagaucuaacaaguccuuuuucagccggcugaauuggcucacacaucugaaguauaaauacccugcccuuaacgucaccaugcccaauaacgagaaguuugacaaacuguauaucuggggagugcaccauccugggacggauucugaccagauuucccucuacgcgcaggccagcggccgcaucacaguuuccaccaagagaucucaacagacagugauuccgaacaucgggagccggccccgcgucagagauauuuccagccggaucucuaucuacuggaccauugugaaaccuggagacauccugcugauuaauuccaccggcaaccucaucgcuccccgcggguauuucaagauuagaagcggaaagucuagcaucaugcgguccgacgccccuaucggcaaauguaauucugaaugcauuacacccaacggcagcaucccgaaugauaagccuuuucagaacgugaaucgcauuacguacggggcuugucccagauaugucaaacagaacacccugaaacuugccacaggaaugcggaauguuccugagaaacaaacccgcggcaucuucggggcgauugccggauuuaucgaaaacggcugggaggggaugguggacggaugguacggcuucagacaccagaauagcgagggcacagggcaggcugccgaucugaaguccacccaagcugccaucaaccagauuaauggaaaacucaaccggcugaucggcaagacgaaugaaaaguuucaccagauugagaaagaguucucugaaguggaagggagaauccaggaccuugagaaguaugucgaggauacaaaaauugaccugugguccuacaacgccgaacuccugguggcucuggagaaccaacauaccaucgaucucaccgacagcgaaaugaauaagcuguucgagcgcacaaagaagcagcuucgggaaaacgcggaggauaugggaaauggcugcuuuaagauuuaucacaaaugugacaacgccugcaucgggucuaucagaaauggcaccuacgaucaugacguuuaccgcgacgaggcucugaacaaucgguuccagauuaagggaguggaacucaaauccggcuauaaggauuggauccuguggauuagcuuugccaucuccugcuuccuucugugugucgcccuccugggguuuauuaugugggcuugccagaaaggaaacaucagaugugacaucugcauuuga

SEQ ID NO: 183085 - RNA, 1701 nt, Artificial Sequence; identical to SEQ ID NO: 183055
  derived and/or modified sequence opt5 from hemagglutinin__InfluenzaA__AAX56410

SEQ ID NO: 183086 - RNA, 1701 nt, Artificial Sequence
  derived and/or modified sequence opt5 from hemagglutinin__InfluenzaA__AAX56420
augaagaccaucauugcccugagcuacuuccucugccugguguuugcucagaaacuucccggcaacgacaauuccacagccacgcugugucucgggcaccaugcggucccuaacggaaccaucguuaagacaauuaccaaugaucaaaucgaggugacaaacgcuaccgaacuggugcagucuagcuccacaggcgggauuugcgacucuccgcaccagauccuugauggagagaauuguacccugaucgacgcccuccugggcgauccccagugcgacggguuccaaaacaaaaagugggaucuguuugucgaaagaagcaaagccuauuccaauuguuacccuuaugacgugcccgauuacgcuucucuccggagccugguugccuccagcggaacgcuugaguucaacaaugaaucuuuugacuggaccggcgugacacagaacggcaccuccagcgcuugcaagcgcagaucuaauaaguccuucuuuagccggcugaacuggcucacacaucugaaauauaaguacccugcccuuaaugucaccaugcccaacaaugagaaauucgauaagcuguauauuuggggagugcaccauccugggacggacucugaucagaucucccucuacgcgcaggccagcggccgcauuacaguuuccaccaaaagaucucaacagacagugaucccgaacauugggagccggccccgcgucagagacguguccagccggaucucuauuuacuggaccaucgugaagccuggagacauccugcugauuaacuccaccggcaaucucaucgcuccccgcggguauuuuaagauuagaagcggaaaaucuagcaucaugcgguccgaugccccuauuggcaaguguaacucugagugcaucacacccaauggcagcaucccgaacgacaaaccuuuccagaaugucaaccgcauuacguacggggcuugucccagauauguuaagcagaauacccugaaacuugccacaggaaugcggaacgugccugaaaagcaaacccgcggcaucuuuggggcgauugccggauucaucgagaauggcugggaagggaugguggauggaugguacggcuuuagacaccagaacuccgagggcacagggcaggcugccgaccugaaaagcacccaagcugccauuaaucagaucaacggaaagcucaaucggcugaucggcaagacgaacgagaaauuccaccagauugaaaaggaguucucugaagucgaggggagaauccaggaucuugaaaaauauguggaggacacaaagauugaucugugguccuacaaugccgagcuccugguugcucuggaaaaccaacauaccaucgaccucaccgauagcgagaugaacaaacuguuugaacgcacaaagaagcagcuucgggagaaugcggaagacaugggaaacggcugcuucaaaauuuaucacaagugugauaaugccugcaucgggucuauuagaaacggcaccuacgaccaugacguguaccgcgaugaggcucugaauaaccgguuucagaucaaaggagucgagcucaaguccggcuauaaagacuggauccuguggauuagcuucgccaucuccugcuuucuucuguguguggcccuccugggguucauuaugugggcuugccagaagggaaauaucagauguaacauuugcaucuga

SEQ ID NO: 183087 - RNA, 1701 nt, Artificial Sequence
  derived and/or modified sequence opt5 from hemagglutinin__InfluenzaA__AAX56430
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgggaucugcgacucuccgcaccagauccuugauggagagaauuguacgcugauugacgcucuccugggcgauccccagugcgacggguuucaaaacaaaaagugggaucuguucgucgaaagaagcaaagccuauuccaauuguuacccuuaugacgugcccgauuacgccucucuccggagccugguugcuuccagcggaacccuugaguuuaacaaugaaucuuucaacuggacaggcgugacccagaauggcacauccagcgccugcgagcgcagaucuaacaaguccuuuuucagccggcugaauuggcucacccaucugaaguauaaauacccugcucuuaacgucacgaugcccaauaacgagaaguuugacaaacuguauaucuggggagugcaccauccugggacagauucugaccagauuucccucuacgcccaggcgagcggccgcaucaccguuuccacaaagagaucucaacagaccgugauuccgaacaucgggagccggccccgcgucagagauguguccagccggauuucuaucuacuggaccaucgugaaaccuggagacauucugcugaucaauuccacaggcaaccucauugcccccagaggguauuucaagaucagaagcggaaagucuagcauuaugcgguccgacgcuccuaucggcaaauguaauucugaaugcaucacgcccaacggcagcauuccgaaugauaagccuuuucagaacgucaaucgcaucaccuacggggccugucccagauauguuaaacagaacacacugaagcuggcuaccggaaugcggaaugugccugagaaacaaacacgcggcauuuucggggccaucgcgggauuuauugaaaacggcugggaggggaugguggacggaugguacggcuucagacaccaaaauuccgagggcaccgggcaggccgcugaucuuaagagcacgcaggccgcuaucaaccagaucaauggaaaacucaaccggcugauuggcaagacaaaugaaaaguuucaccagaucgagaaagaguucucugaagucgaagggcgcauucaggaccuugagaaguauguggaggauaccaaaaucgaccugugguccuacaacgccgaacuccugguugcccuggagaaccaacauaccauugaucucacagacagcgaaaugaauaagcuguucgagcgcaccaaaaagcagcuucgggaaaacgcugaggauaugggaaauggcugcuuuaagaucuaucacaaaugugacaacgcgugcauugggucuaucagaaauggcacauacgaucaugacguguaccgcgacgaggcccugaacaaucgguuccagaucaagggagucgaacucaaauccggcuauaaggauuggauucuguggaucagcuuugcuauuuccugcuuccuucuguguguggcccuccugggguuuaucaugugggccugccagaaaggaaacauuagaugugacaucugcaucuga

SEQ ID NO: 183088 - RNA, 1701 nt, Artificial Sequence
  derived and/or modified sequence opt5 from hemagglutinin__InfluenzaA__AAX56440
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuagcacaggcagaauuugcgacuccccgcaccagauccuggauggggagaacuguacccucaucgacgcccugcugggagauccccauugcgacggcuuucagaauaaagaaugggaucucuucgucgagcggucuaaggccuauagcaacuguuacccuuaugacgugcccgauuacguuucccugcgcucucuuguggcuagcuccgggacgcuggaauuuaauaacgagagcuucaauuggaccggagucgcccagaacggcacaucuuccgcuugcaaaagacggagcgacaaguccuuuuucucucgccucaauuggcugcaccagcuuaaguauaaauacccugcccugaacgugaccaugcccaauaacgagaaguuugauaaacucuauauuuggggcguucaucacccugggacagacaacgaucagaucagccuguacgcgcaggccucuggaagagugaccgucuccacgaagcggagccaacagacagugauuccgaauaucggcuccgggcccugggugcgcggagucucuagcagaauuuccaucuacuggaccauuguuaaaccuggcgacauccugcucaucaacagcacagggaaucugauugcuccccggggauauuucaagauccgcucuggcaaguccagcauuaugagaucugacgccccuaucggcaaauguaacagcgaaugcauuacccccaauggguccaucccgaacgauaagccuuuucagaaugugaaccggaucaccuacggacccuguccucgcuaugugaaacagaauacacuuaagcuggcuacgggcaugagaaacguccccgagaaacaaacccgggggauuuucggagccaucgcgggcuuuauugaaaaugggugggagggaaugauggacggcugguacggcuuccgccaccagaacucugaggggacaggacaggccgcugaucucaagagcacccaagccgcuaucaaucagauuaacggcaaacugaauagacuuaucgaaaagacaaacgagaaguuucaucagaucgaaaaagaguucuccgaaguggaggggcggauucaggaccuggagaaguauguugaagauaccaaaaucgaccucuggagcuacaacgccgagcugcugguggcccucgaaaaucaacacacgauugaucugacagacucugagaugaacaaacuuuucgaaagaaccaagaagcagcugcgcgagaaugcugaggauaugggaaacggcugcuuuaagaucuaucauaaaugugacaaugcgugcauuggguccauccggaacggcaccuacgaucacgacgucuacagagacgaagcccucaauaaccgcuuccagauuaagggaguggagcugaaaagcggcuauaaggauuggauccuuuggaucucuuuugcuauuuccugcuuccugcucuguaucguucugcugggguuuauuaugugggccugccagaaaggaaauauccgguguaacauuugcaucuga

SEQ ID NO: 183089 - RNA, 1701 nt, Artificial Sequence; identical to SEQ ID NO: 183071
  derived and/or modified sequence opt5 from hemagglutinin__InfluenzaA__AAX56450

SEQ ID NO: 183090 - RNA, 1701 nt, Artificial Sequence
  derived and/or modified sequence opt5 from hemagglutinin__InfluenzaA__AAX56460
augaagaccaucauugcccugagcuacauccucugccugguguucgcucagaaacuucccgagaacgacaauuccacagccacgcugugucucggccaccaugcggucccuaacgggacccugguuaagacaauuaccaaugaucaaaucgaagugacaaacgcuaccgagcuugugcagucuagcuccacaggaagaauuugcgacucuccgcaccagauccuggauggcgaaaauuguacccucaucgacgcccugcugggggauccccauugcgacggauuucagaacaaagagugggaucucuucgucgaacggagcaaggccuauuccaauuguuacccuuaugacgugcccgauuacguuucucugcgcagccuuguggcuuccagcggcacgcuggaguuuaacaaugagucuuucaacuggaccggggucgcccaaaauggaacauccagcgcuugcaaaagacggucugacaaguccuuuuucagccgccucaacuggcugcaccagcuuaaguauaaauacccugcccugaaugugaccaugcccaacaaugaaaaguuugauaaacucuauauuuggggcguucaucacccuggcacagacucugaucagaucucccuguacgcgcaggccagcgggagagugaccgucuccacgaagcggucucaacagacagugauuccgaacaucggaagccgccccugggugagaggcgucuccagccggauuucuaucuacuggaccauuguuaaaccuggggacauccugcucaucaacuccacaggaaaucugauugcuccccgcggcuauuucaagaucagaagcgggaagucuagcauuaugcgguccgacgccccuaucggaaaauguaacucugagugcauuacccccaauggcagcaucccgaacgauaagccuuuucagaaugugaaccgcaucacccacggccccuguccuagauacgugaaacagaauacacuuaagcuggcuacggggaugcggaacguccccgaaaaacaaacccgcggaauuuucggcgccaucgcgggguuuauugagaauggaugggagggcaugauggacgggugguauggauucagacaucagaacuccgaaggcacaggccaggccgcugaucucaagagcacccaagccgcuaucaaucagauuaacgggaaacugaaucggcuuaucgagaagacaaacgaaaaguuucaccagaucgagaaagaguucucugaaguggagggacgcauucaggaccuggaaaaguacguugaggauaccaaaaucgaccucugguccuauaaugccgaacugcugguggcccucgagaaccaacauacgauugaucugacagacagcgaaaugaacaaacuuuucgagagaaccaagaagcagcugcgggagaaugcugaagauaugggcaacgggugcuuuaagaucuaccacaaaugugacaaugcgugcauuggaucuaucagaaacggcaccuaugaucacgacgucuaccgcgacgaggcccucaauaaccgguuccagauuaaggggguggaacugaaauccggcuacaaggauuggauccuuuggaucagcuuugcuauuuccugcuuccugcucuguaucguucugcugggauuuauuaugugggccugccagaaaggcaauaucagauguaacauuugcaucuga

SEQ ID NO: 183091 - RNA, 1701 nt, Artificial Sequence
  derived and/or modified sequence opt5 from hemagglutinin__InfluenzaA__AAX56470
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaugagaagcggaaagucuagcaucaugcgguccgacgccccuauuggcaaauguaacucugaaugcaucacccccaauggcagcauuccgaacgauaagccuuuucagaaugugaaccgcaucaccuacgggcccuguccuagauaugugaaacagaauacacuuaagcuggcuacgggaaugcggaacguccccgagaaacaaacccgcggcaucuucggggccauugcgggauuuaucgaaaauggcugggaggggaugauggacggaugguacggcuucagacaccagaacuccgagggcacagggcaggccgcugaucucaagagcacccaagccgcuauuaaucagaucaacggaaaacugaaucggcuuauugaaaagacaaacgagaaguuucaucagaucgaaaaagaguucucugaaguggagggcagaauccaggaccuggagaaguauguugaagauaccaaaauugaccucugguccuacaaugccgagcugcugguggcccucgaaaaccaacacacgaucgaucugacagacagcgagaugaacaaacuuuucgaacgcaccaagaagcagcugcgggagaaugcugaggauauggggaacggaugcuuuaagauuuaucauaaaugugacaaugcgugcaucggcucuauuagaaacgggaccuacgaucacgacgucuaccgcgacgaagcccucaauaaccgguuccagaucaagggcguggagcugaaauccggauauaaggauuggauucuuuggaucagcuuugcuaucuccugcuuccugcucuguauuguucugcugggcuuuaucaugugggccugccagaaagggaauauuagauguaacaucugcauuuga

SEQ ID NO: 183092 - RNA, 1701 nt, Artificial Sequence; identical to SEQ ID NO: 183075
  derived and/or modified sequence opt5 from hemagglutinin__InfluenzaA__AAX56480

SEQ ID NO: 183093 - RNA, 1701 nt, Artificial Sequence
  derived and/or modified sequence opt5 from hemagglutinin__InfluenzaA__AAX56510
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagcaaaauuucuaucuacuggaccauuguuaagccuggagacauccugcucaucaacuccacaggcaaucugauugcuccccggggguauuucaagauccgcagcggaaaaucuagcauuaugagauccgacgccccuaucggcaaguguaacucugaaugcauuacccccaauggcagcaucccgaacgauaaaccuuuucagaaugugaaccggaucaccuacggggcuuguccccgcuaugugaagcagaauacacuuaaacuggccacgggaaugagaaacgucccugagaagcaaacccggggcauuuucggggcgaucgccggauuuauugaaaauggcugggaggggaugauggacggaugguacggcuuccgccaccagaacuccgagggcacagggcaggcugccgaucucaaaagcacccaagcugccaucaaucagauuaacggaaagcugaauagacuuaucgaaaagacaaacgagaaauuucaucagaucgaaaaggaguucucugaaguggagggccggauucaggaccuggagaaauauguugaagauaccaagaucgaccucugguccuacaaugccgagcugcugguggcucucgaaaaccaacacacgauugaucugacagacagcgagaugaacaaacuuuucgaaagaaccaagaagcagcugcgcgagaaugcggaggauauggggaacggaugcuuuaaaaucuaucauaagugugacaaugccugcauuggcucuauccggaacgggaccuacgaucacgacgucuacagagacgaagcucucaauaaccgcuuccagauuaaaggcguggagcugaaguccggauauaaagauuggauccuuuggaucagcuuugccauuuccugcuuccugcucuguaucguucugcugggcuuuauuaugugggccugccagaaggggaauauccgguguaacauuugcaucuga

SEQ ID NO: 183094 - RNA, 1701 nt, Artificial Sequence; identical to SEQ ID NO: 183071
  derived and/or modified sequence opt5 from hemagglutinin__InfluenzaA__AAX56520

SEQ ID NO: 183095 - RNA, 1701 nt, Artificial Sequence
  derived and/or modified sequence opt5 from hemagglutinin__InfluenzaA__AAX56530
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcaucgccggguggauucugggaaacccugagugcgaaucccucuuuucuaaagagagcugguccuacaucgccgaaaccccgaaucccaagaacggcacguguuauccuggguacuucgccgacuaugaggagcugcgggaacaacuuucuagcguguccagcuuugagcgcuucgaaauuuuucccaaggauucuuccuggccuaaucauaccguuacaaaaggagugaccgcuagcugcucucacaacggcaaguccagcuucuacaaaaaucugcucuggcugacagagaagaacggccuuuaucccaaucugucuaaauccuacgucaacaagaaggggaaagaggugcucguucuguggggagugcaucacccuagcaauaugggcgaccagagagccaucuaccacaaggaaaacgcguaugucuccgugcugucuagccauuacucccggcgcuuuaccccggagaucgccaaaagacccaaggugcgggaucaggaagggcgcauuaacuauuacuggacgcuccuggagccuggagacacaaucauuuucgaagcuaauggcaaccuuaucgcccccugguaugcuuuugcccugagcagaggguucggaucuggcauuaucauuuccaaugcgagcaugggcgagugugaugccaaaugccagaccccucaaggggcuaucaacucuagccuccccuuucagaauguccacccgguuacaaucggagaguguccuaaguacgugcgguccaccaaacugcgcauggugaccggccuuagaaacguccccucuauucagagccgggggcuguucggagccaucgcuggcuuuauugaagggggauggacaggcaugaucgacggcugguauggguaccaucaccagaaugagcaaggauccggcuacgccgccgaucagaaaagcacgcagaacgcuauuaaugggaucaccaacaagguuaauucuaucauugaaaagaugaacacacaguucaccgcggugggaaaggaguucaauaaacucgaaaagcgcauggagaaccugaauaaaaagguggacgauggcuuucuggacaucuggacauauaacgccgagcuccugguccuucuggaaaacgagagaacccucgacuuccacgaucugaaugugaagaaccuuuacgaaaaaguuaagaaucaacugaaaaacaaugcuaaggagauugggaacggcugcuuugaguucuaucauaaauguaauaacgaaugcauggaguccgugaagaauggaacguacgacuauccuaaguacagcaaagaaucuaagcucaaccgggagaaaaucgauggcgucaagcuggaauccauggggguguaucagauucuggccaucuacagcacagucgccuccucucucgugcugcuuguuagccugggagcuaucuccuuuuggaugugcucuaauggcagccuccagugucgcauuugcaucuga

SEQ ID NO: 183096 - RNA, 1701 nt, Artificial Sequence
  derived and/or modified sequence opt5 from hemagglutinin__InfluenzaA__AAX56550
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugguggacggcugguacggguucagacaucaaaauagcgagggaaccggccaggccgcugaucucaaaucuacacaggccgccauuaaccaaaucaauggcaagcugaaccggcuuaucgagaaaaccaaugaaaaguuucaccagauugaaaaggaguucuccgaaguugaggggagaauccaggaccuggagaaauauguggaagauacgaagauugaccucuggagcuacaacgcugagcugcuggucgcgcucgaaaaccagcauacaaucgaucugaccgacucugagaugaauaaacuuuucgaacgcacccggaagcaacugagagagaacgccgaggauaugggaaauggcugcuuuaaaauuuaucacaagugugacaacgcuugcaucggguccauucgcaauggaacauacgaucacgacguguaccgggaugaagcccucaacaauagauuccagaucaagggcguugagcugaaaagcggguauaaggacuggauccuuuggauuuccuuugccaucucuugcuuccugcucugugugguccugcugggcuuuauuaugugggcuugccagaaaggaaacauccgcuguaauauuugcaucuga

SEQ ID NO: 183097 - RNA, 1701 nt, Artificial Sequence
  derived and/or modified sequence opt5 from hemagglutinin__InfluenzaA__AAX56560
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacagcgaucagaucucucucuacgcgcaggccuccggccgcauuacaguuagcaccaaaagaucccaacagacagugaucccgaacauugggucucggccccgcgucagagacgugagcucccggaucagcaucuacuggaccauugugaagccuggagacauccugcugauuaacucuaccggcaaucucaucgcuccccgcggguauuucaagauuagauccggaaaaagcucuaucaugcggagcgaugccccuaucggcaaguguaacuccgagugcauuacacccaauggcucuaucccgaacgacaaaccuuuucagaaugucaaccgcauuacguacggggcuugucccagauauguuaagcagaauacccugaaacuugccacaggaaugcggaacgugccugaaaagcaaacccgcggcaucuucggggcgauugccggauuuaucgagaauggcugggaagggaugguggauggaugguacggcuucagacaccagaacagcgagggcacagggcaggcugccgaccugaaauccacccaagcugccaucaaucagauuaacggaaagcucaaucggcugaucggcaagacgaacgagaaauuucaccagauugaaaaggaguucagcgaagucgaggggagaauccaggaucuugaaaaauauguggaggacacaaagauugaucuguggucuuacaaugccgagcuccugguugcucuggaaaaccaacauaccaucgaccucaccgauuccgagaugaacaaacuguucgaacgcacaaagaagcagcuucgggagaaugcggaagacaugggaaacggcugcuuuaaaauuuaucacaagugugauaaugccugcaucgggagcaucagaaacggcaccuacgaccaugacguguaccgcgaugaggcucugaauaaccgguuccagauuaaaggagucgagcucaagucuggcuauaaagacuggauccuguggauuuccuuugccaucagcugcuuccuucuguguguggcccuccugggguuuauuaugugggcuugccagaagggaaauaucagauguaacaucugcauuuga

SEQ ID NO: 183098 - RNA, 1701 nt, Artificial Sequence
  derived and/or modified sequence opt5 from hemagglutinin__InfluenzaA__AAX56570
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggaucccgccccugggugagaggcgucagcucugggauuuccaucuacuggaccauuguuaaaccuggagacauccugcucaucaacagcacaggcaaucugauugcuccccggggguauuucaagauccgcucuggaaagagcuccauuaugagaucugacgccccuaucggcaaauguaacagcgaaugcauuacccccaauggcuccaucccgaacgauaagccuuuucagaaugugaaccggaucaccuacggggcuuguccccgcuaugugaaacagaauacacuuaagcuggccacgggaaugagaaacgucccugagaaacaaacccggggcauuuucggggcgaucgccggauuuauugaaaauggcugggaggggaugauggacggaugguacggcuuccgccaccagaacagcgagggcacagggcaggcugccgaucucaagucuacccaagcugccaucaaucagauuaacggaaaacugaauagacuuaucgaaaagacaaacgagaaguuucaucagaucgaaaaagaguucuccgaaguggagggccggauucaggaccuggagaaguauguugaagauaccaaaaucgaccucuggagcuacaaugccgagcugcugguggcucucgaaaaccaacacacgauugaucugacagacucugagaugaacaaacuuuucgaaagaaccaagaagcagcugcgcgagaaugcggaggauauggggaacggaugcuuuaagaucuaucauaaaugugacaaugccugcauuggcuccauccggaacgggaccuacgaucacgacgucuacagagacgaagcucucaauaaccgcuuccagauuaagggcguggagcugaaaagcggauauaaggauuggauccuuuggaucuccuuugccauuucuugcuuccugcucuguaucguucugcugggcuuuauuaugugggccugccagaaagggaauauccgguguaacauuugcaucuga

SEQ ID NO: 183099 - RNA, 1701 nt, Artificial Sequence
  derived and/or modified sequence opt5 from hemagglutinin__InfluenzaA__AAX56590
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuuccacagacagcgaucagaucucccuguacgcgcaggccucuggcagagugaccgucagcacgaagcggucccaacagacagugauuccgaacaucgggagccgccccugggugagaggagucucuucccggauuagcaucuacuggaccauuguuaaaccuggcgacauccugcucaucaacucuacagggaaucugauugcuccccgcggauauuucaagaucagaagcggcaaguccucuauuaugcggagcgacgccccuaucgggaaauguaacuccgaaugcauuacccccaauggaagcaucccgaacgauaagccuuuucagaaugugaaccgcaucaccuacggcgcuugucccagauaugugaaacagaauacacuuaagcuggccacgggcaugcggaacgucccugagaaacaaacccgcgggauuuucggagcgaucgccggcuuuauugaaaaugggugggagggaaugauggacggcugguacggguucagacaccagaacucugagggaacaggccaggcugccgaucucaaguccacccaagcugccaucaaucagauuaacggcaaacugaaucggcuuaucgaaaagacaaacgagaaguuucaucagaucgaaaaagaguucagcgaaguggaggggcgcauucaggaccuggagaaguauguugaagauaccaaaaucgaccucuggucuuacaaugccgagcugcugguggcucucgaaaaccaacacacgauugaucugacagacuccgagaugaacaaacuuuucgaaagaaccaagaagcagcugcgggagaaugcggaggauaugggaaacggcugcuuuaagaucuaucauaaaugugacaaugccugcauugggagcaucagaaacggaaccuacgaucacgacgucuaccgcgacgaagcucucaauaaccgguuccagauuaagggcguggagcugaaauccggguauaaggauuggauccuuuggaucucuuuugccauuagcugcuuccugcucuguaucguucugcugggcuuuauuaugugggccugccagaaaggaaauaucagauguaacauuugcaucuga

SEQ ID NO: 183100 - RNA, 1701 nt, Artificial Sequence; identical to SEQ ID NO: 183097
  derived and/or modified sequence opt5 from hemagglutinin__InfluenzaA__AAX56600

SEQ ID NO: 183101 - RNA, 1701 nt, Artificial Sequence
  derived and/or modified sequence opt5 from hemagglutinin__InfluenzaA__AAX57644
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccguggucaagccuggagacauccugcugauuaacuccaccggcaaucucaucgcuccccgcggguauuucaagaugagaagcggaaaaucuagcauuaugcgguccgaugccccuaucggcaaguguaacucugagugcauuacacccaauggcagcaucccgaacgacaaaccuuuucagaauguuaaccgcaucacguacggggcuugucccagauaugugaagcagaauacccugaaacuugccacaggaaugcggaacgugccugaaaagcaaacccgcggcauuuucggggcgaucgccggauuuauugagaauggcugggaagggauggucgauggaugguacggcuucagacaccagaacuccgagggcacagggcaggcugccgaccugaaaagcacccaagcugccaucaaucagauuaacggaaagcucaaucggcugaucggcaagacgaacgagaaauuucaccagaucgaaaaggaguucucugaaguggaggggcgcauucaggaucuugaaaaauauguugaggacacaaagaucgaucugugguccuacaaugccgagcuccugguggcucuggaaaaccaacauaccauugaccucaccgauagcgagaugaacaaacuguucgaaagaacaaagaagcagcuucgggagaaugcggaagacaugggaaacggcugcuuuaaaaucuaucacaagugugauaaugccugcauugggucuaucagaaacggcaccuacgaccaugacgucuaccgcgaugaggcucugaauaaccgguuccagauuaaaggaguggagcucaaguccggcuauaaagacuggauccuguggaucagcuuugccauuuccugcuuccuucuguguguugcccuccugggguuuaucaugugggcuugccagaagggaaauauuagauguaacaucugcauuuga

SEQ ID NO: 183102 - RNA, 1701 nt, Artificial Sequence; identical to SEQ ID NO: 183055
  derived and/or modified sequence opt5 from hemagglutinin__InfluenzaA__AAX57654

SEQ ID NO: 183103 - RNA, 1701 nt, Artificial Sequence; identical to SEQ ID NO: 183071
  derived and/or modified sequence opt5 from hemagglutinin__InfluenzaA__AAX57664

SEQ ID NO: 183104 - RNA, 1701 nt, Artificial Sequence
  derived and/or modified sequence opt5 from hemagglutinin__InfluenzaA__AAX57684
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggauccggccccugggugcgcggggucagcucuagaauuuccaucuacuggaccauuguuaaaccuggagacauccugcucaucaacagcacaggcaaucugauugcuccccggggguauuucaagauccgcucuggaaagagcuccauuaugagaucugacgccccuaucggcaaauguaacagcgaaugcauuacccccaauggcuccaucccgaacgauaagccuuuucagaaugugaaccggaucaccuacggggcuuguccccgcuaugugaaacagaauacacuuaagcuggccacgggaaugagaaacgucccugagaaacaaacccggggcauuuucggggcgaucgccggauuuauugaaaauggcugggaggggaugauggacggaugguacggcuuccgccaccagaacagcgagggcacagggcaggcugccgaucucaagucuacccaagcugccaucaaucagauuaacggaaaacugaauagacuuaucgaaaagacaaacgagaaguuucaucagaucgaaaaagaguucuccgaaguggagggccggauucaggaccuggagaaguauguugaagauaccaaaaucgaccucuggagcuacaaugccgagcugcugguggcucucgaaaaccaacacacgauugaucugacagacucugagaugaacaaacuuuucgaaagaaccaagaagcagcugcgcgagaaugcggaggauauggggaacggaugcuuuaagaucuaucauaaaugugacaaugccugcauuggcuccauccggaacgggaccuacgaucacgacgucuacagagacgaagcucucaauaaccgcuuccagauuaagggcguggagcugaaaagcggauauaaggauuggauccuuuggaucuccuuugccauuucuugcuuccugcucuguaucguucugcugggcuuuauuaugugggccugccagaaagggaauauccgguguaacauuugcaucuga

SEQ ID NO: 183105 - RNA, 1701 nt, Artificial Sequence; identical to SEQ ID NO: 183075
  derived and/or modified sequence opt5 from hemagglutinin__InfluenzaA__AAX57694

SEQ ID NO: 183106 - RNA, 1701 nt, Artificial Sequence; identical to SEQ ID NO: 183097
  derived and/or modified sequence opt5 from hemagglutinin__InfluenzaA__AAX57704

SEQ ID NO: 183107 - RNA, 1701 nt, Artificial Sequence; identical to SEQ ID NO: 183075
  derived and/or modified sequence opt5 from hemagglutinin__InfluenzaA__AAX57714

SEQ ID NO: 183108 - RNA, 1701 nt, Artificial Sequence; identical to SEQ ID NO: 183104
  derived and/or modified sequence opt5 from hemagglutinin__InfluenzaA__AAX57733

SEQ ID NO: 183109 - RNA, 1701 nt, Artificial Sequence
  derived and/or modified sequence opt5 from hemagglutinin__InfluenzaA__AAX57734
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcaauagcccgcaccagauccuggacggcgagaacuguacccucaucgaugcccugcugggggacccccauugcgauggauuucagaauaaagaaugggaccucuucgucgagcgguccaaggccuauucuaacuguuacccuuaugaugugcccgacuacguuagccugcgcucccuuguggcuagcucuggcacgcuggaauuuaauaacgaguccuucaauuggaccggggucgcccaaaacggaacaagcucugcuugcaaaagacgguccgauaagagcuuuuucucucgccucaauuggcugcaccagcuuaaguauaaauacccugcccugaacgugaccaugcccaauaacgagaaguuugacaaacucuauauuuggggcguucaucacccuggcacagauuccgaccagaucagccuguacgcgcaggccuccgggagagugaccgucucuacgaagcggagccaacagacagugauuccgaacaucggauccggccccugggugcgcggggucagcucuagaauuuccaucuacuggaccauuguuaaaccuggagauauccugcucaucaauagcacaggcaaccugauugcuccccggggguauuucaagauccgcucuggaaagagcuccauuaugagaucugacgccccuaucggcaaauguaauagcgaaugcauuacccccaacggcuccaucccgaaugacaagccuuuucagaacgugaaucggaucaccuacggggcuuguccccgcuaugugaaacagaacacacuuaagcuggccacgggaaugagaaaugucccugagaaacaaacccggggcauuuucggggcgaucgccggauuuauugaaaacggcugggaggggaugauggauggaugguacggcuuccgccaccagaauagcgagggcacagggcaggcugccgaccucaagucuacccaagcugccaucaaccagauuaauggaaaacugaacagacuuaucgaaaagacaaaugagaaguuucaucagaucgaaaaagaguucuccgaaguggagggccggauucaggaucuggagaaguauguugaagacaccaaaaucgaucucuggagcuacaacgccgagcugcugguggcucucgaaaaccaacacacgauugaccugacagauucugagaugaauaaacuuuucgaaagaaccaagaagcagcugcgcgagaacgcggaggacauggggaauggaugcuuuaagaucuaucauaaaugugauaacgccugcauuggcuccauccggaaugggaccuacgaccacgaugucuacagagacgaagcucucaacaaucgcuuccagauuaagggcguggagcugaaaagcggauauaaggacuggauccuuuggaucuccuuugccauuucuugcuuccugcucuguaucguucugcugggcuuuauuaugugggccugccagaaagggaacauccgguguaauauuugcaucuga

SEQ ID NO: 183110 - RNA, 1701 nt, Artificial Sequence; identical to SEQ ID NO: 183096
  derived and/or modified sequence opt5 from hemagglutinin__InfluenzaA__AAX57744

SEQ ID NO: 183111 - RNA, 1701 nt, Artificial Sequence; identical to SEQ ID NO: 183096
  derived and/or modified sequence opt5 from hemagglutinin__InfluenzaA__AAX57764

SEQ ID NO: 183112 - RNA, 1701 nt, Artificial Sequence; identical to SEQ ID NO: 183096
  derived and/or modified sequence opt5 from hemagglutinin__InfluenzaA__AAX57774

SEQ ID NO: 183113 - RNA, 1701 nt, Artificial Sequence
  derived and/or modified sequence opt5 from hemagglutinin__InfluenzaA__AAX57784
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuagcacauccagaauuugcgacucuccgcaccagauccuggauggcgagaacuguacccucaucgacgcccugcugggggauccccauugcgacggauuucagaauaaagaaugggaucucuucgucgagcggagcaaggccuauuccaacuguuacccuuaugacgugcccgauuacguuucucugcgcagccuuguggcuuccagcggcacgcuggaauuuaauaacgagucuuucaauuggaccggggucgcccagaacggaacauccagcgcuugcaaaagacggucugacaaguccuuuuucagccgccucaauuggcugcaccagcuuaaguauaaauacccugcccugaacgugaccaugcccaauaacgagaaguuugauaaacucuauauuuggggcguucaucacccuggcacagacucugaucagaucucccuguacgcgcaggccagcgggagagugaccgucuccacgaagcggucucaacagacagugauuccgaacaucggaagccgccccugggugagaggcgucuccagccggauuucuaucuacuggaccauuguuaaaccuggggacauccugcucaucaauuccacaggaaaccugauugcuccccgcggcuauuucaagaucagaagcgggaagucuagcauuaugcgguccgacgccccuaucggaaaauguaauucugaaugcauuacccccaacggcagcaucccgaaugauaagccuuuucagaacgugaaucgcaucaccuacggcgcuugucccagauaugugaaacagaacacacuuaagcuggccacggggaugcggaaugucccugagaaacaaacccgcggaauuuucggcgcgaucgccggguuuauugaaaacggaugggagggcaugauggacgggugguacggauucagacaccaaaauuccgagggcacaggccaggcugccgaucucaagagcacccaggcugccaucaaccagauuaaugggaaacugaaccggcuuaucgaaaagacaaaugagaaguuucaucagaucgaaaaagaguucucugaaguggagggacgcauucaggaccuggagaaguauguugaagauaccaaaaucgaccucugguccuacaacgccgagcugcugguggcucucgaaaaccaacacacgauugaucugacagacagcgagaugaauaaacuuuucgaaagaaccaagaagcagcugcgggagaacgcggaggauaugggcaaugggugcuuuaagaucuaucauaaaugugacaacgccugcauuggaucuaucagaaauggcaccuacgaucacgacgucuaccgcgacgaagcucucaacaaucgguuccagauuaaggggguggagcugaaauccggcuauaaggauuggauccuuuggaucagcuuugccauuuccugcuuccugcucuguaucguucugcugggauuuauuaugugggccugccagaaaggcaacaucagauguaauauuugcaucuga

SEQ ID NO: 183114 - RNA, 1701 nt, Artificial Sequence
  derived and/or modified sequence opt5 from hemagglutinin__InfluenzaA__AAX57794
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauucauuggacaaucguuaagccuggcgauauccugcucauuaacagcaccgggaaucugaucgcuccccgcggauacuucaaaauuagaucuggcaagagcuccaucaugcggucuaacgccccuauugggaaguguaauagcgaaugcaucacccccaacggauccaucccgaaugacaaaccuuuucagaacgugaaucgcauuacauauggcgccugucccagauacgugaagcagaacacgcuuaaacuggcgaccggcaugcggaaugucccugagaagcagacacgcgggaucuucggagccauugcuggcuuuaucgaaaacgggugggagggaaugguggacggcugguauggguucagacaccaaaauagcgagggaaccggccaggccgcugaucucaaaucuacacaggccgccauuaaccaaaucaauggcaagcugaaccggcuuaucgagaaaaccaaugaaaaguuucaucagauugaaaaggaguucuccgaaguugaggggagaauccaggaccuggagaaauacguggaagauacgaagauugaccucuggagcuauaacgcugagcugcuggucgcgcucgaaaaccagcacacaaucgaucugaccgacucugagaugaauaaacuuuucgaacgcacccggaagcaacugagagagaacgccgaggauaugggaaauggcugcuuuaaaauuuaccacaagugugacaacgcuugcaucggguccauucgcaauggaacauaugaucaugacguguaccgggaugaagcccucaacaauagauuccagaucaagggcguugagcugaaaagcggguacaaggacuggauccuuuggauuuccuuugccaucucuugcuuccugcucugugugguccugcugggcuuuauuaugugggcuugccagaaaggaaacauccgcuguaauauuugcaucuga

SEQ ID NO: 183115 - RNA, 1701 nt, Artificial Sequence; identical to SEQ ID NO: 183096
  derived and/or modified sequence opt5 from hemagglutinin__InfluenzaA__AAX57814

SEQ ID NO: 183116 - RNA, 1701 nt, Artificial Sequence
  derived and/or modified sequence opt5 from hemagglutinin__InfluenzaA__AAX57824
augaagaccaucauugcccugagcuacauccucugcaugguguucgcucagaaacugcccgucaacgacaauuccacagccacgcuuugucugggccaccaugcgguuccuaacgggacccucgugaagacaauuaccaaugaucacaucgaggugacaaacgcuaccgaacugguccaaucuagcuccacaggaagaauuugcgacucuccgcaucagauccuugauggcgagaauuguacccugaucgacgcccuccugggggauccccacugcgacggauuucagaacaaagaaugggaucuguucguggagcggagcacggccuauuccaauuguuacccuuaugacguucccgauuacgcuucucuccgcagccugguggccuccagcggcacccuugaauuuaacaaugagucuuucaacuggacaggggucgcucagaauggaaccuccagcgccugcaagagacggucuauuaaauccuuuuucagccgccugaacuggcuccaucaacugaaguauaaguacccugcgcuuaaugugacaaugcccaacaaugagaaauuugacaagcuguauaucuggggcguucaccacccuucuaccgauuccgaccagauuagccucuacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcugauuaacagcaccgggaaucucaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcugaaacuugcgaccggcaugcggaaugucccugagaagcagacacgcgggaucuucggagccauugcuggcuuuaucgaaaacgggugggagggaaugguggacggcugguacggguucagacaucaaaauagcgagggaaccggccaggccgcugaucugaaaucuacacaggccgccauuaaccaaaucaauggcaagcucaaccggcugaucgagaaaaccaaugaaaaguuucaccagauugaaaaggaguucuccgaaguugaggggagaauccaggaccuugagaaauauguggaagauacgaagauugaccuguggagcuacaacgcugagcuccuggucgcgcuggaaaaccagcauacaaucgaucucaccgacucugagaugaauaaacuguucgaacgcacccggaagcaacuuagagagaacgccgaggauaugggaaauggcugcuuuaaaauuuaucacaagugugacaacgcuugcaucggguccauucgcaauggaacauacgaucacgacguguaccgggaugaagcccugaacaauagauuccagaucaagggcguugagcucaaaagcggguauaaggacuggauccuguggauuuccuuugccaucucuugcuuccuucugugugugguccuccugggcuuuauuaugugggcuugccagaaaggaaacauccgcuguaauauuugcaucuga

SEQ ID NO: 183117 - RNA, 1701 nt, Artificial Sequence; identical to SEQ ID NO: 183096
  derived and/or modified sequence opt5 from hemagglutinin__InfluenzaA__AAX57834

SEQ ID NO: 183118 - RNA, 1701 nt, Artificial Sequence; identical to SEQ ID NO: 183096
  derived and/or modified sequence opt5 from hemagglutinin__InfluenzaA__AAX57844

SEQ ID NO: 183119 - RNA, 1701 nt, Artificial Sequence
  derived and/or modified sequence opt5 from hemagglutinin__InfluenzaA__AAX57864
augaagaccaucauugcccugagcuacuuccucugccugguguuugcucagaaacuucccgucaacgacaauuccacagccacgcugugucucggccaccaugcgguuccuaacgggacccuggugaagacaaucaccaaugaucacauugaggugacaaacgcuaccgaacuuguccaaucuagcuccacaggaagaaucugcgacucuccgcaucagauucuggauggcgagaauuguacccucaucgacgcccugcugggggauccccacugcgacggauuccagaacaaagaaugggaucucuuuguggagcggagcacggccuauuccaauuguuacccuuaugacguucccgauuacgcuucucugcgcagccuuguggccuccagcggcacccuggaguucaacaaugaaucuuuuaacuggacaggggucgcucagaauggaaccuccagcgccugcaagagacggucuaucaaauccuucuuuagccgccucaacuggcugcaucaacuuaaguauaaguacccugcgcugaaugugacaaugcccaacaaugagaaauucgacaagcucuauauuuggggcguucaccacccuucuaccgauuccgaccagaucagccuguacgcccaggcuuccggcagagugacggucucuacaaaacggagccagcaaaccgugauuccgaacaucgggucccgccccugggugagaggagucagcucucggauuuccaucuacuggacaauuguuaagccuggcgauauccugcucaucaacagcaccgggaaucugauugcccccagaggauauuuuaaaaucagaucuggcaagagcuccauuaugcggucuaacgcuccuaucgggaaguguaauagcgaaugcauuacccccaacggauccaucccgaaugacaaaccuuuccagaacgugaaucgcaucacauacggcgccugucccagauaugugaagcagaacacgcuuaaacuggcgaccggcaugcggaaugucccugagaagcagacacgcgggauuuuuggagccaucgcuggcuucauugaaaacgggugggagggaaugguggacggcugguacggguuuagacaucaaaauagcgagggaaccggccaggccgcugaucucaaaucuacacaggccgccaucaaccaaauuaauggcaagcugaaccggcuuaucgagaaaaccaaugaaaaguuccaccagaucgaaaaggaguucuccgaaguugaggggcgcauucaggaccuggagaaauauguggaagauacgaagaucgaccucuggagcuacaacgcugagcugcuggucgcgcucgaaaaccagcauacaauugaucugaccgacucugagaugaauaaacuuuuugaacgcacccggaagcaacugagagagaacgccgaggauaugggaaauggcugcuucaaaaucuaucacaagugugacaacgcuugcauuggguccauccgcaauggaacauacgaucacgacguguaccgggaugaagcccucaacaauagauuucagauuaagggcguugagcugaaaagcggguauaaggacuggauccuuuggaucuccuucgccauuucuugcuuucugcucugugugguccugcugggcuucaucaugugggcuugccagaaaggaaacauucgcuguaauaucugcauuuga

SEQ ID NO: 183120 - RNA, 1701 nt, Artificial Sequence; identical to SEQ ID NO: 183096
  derived and/or modified sequence opt5 from hemagglutinin__InfluenzaA__AAX57874

SEQ ID NO: 183121 - RNA, 1701 nt, Artificial Sequence; identical to SEQ ID NO: 183096
  derived and/or modified sequence opt5 from hemagglutinin__InfluenzaA__AAX57884

SEQ ID NO: 183122 - RNA, 1701 nt, Artificial Sequence
  derived and/or modified sequence opt5 from hemagglutinin__InfluenzaA__AAX57894
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucaggugcuggauggcgagaauuguacccucaucgacgcccugcugggggauccccacugcgacggauuucagaacaaagaaugggaucucuucguugagcggagcacggccuauuccaauuguuacccuuaugacgugcccgauuacgcuucucugcgcagccuugucgccuccagcggcacccuggaauuuaacaaugagucuuucaacuggacagggguggcucagaauggaaccuccagcgccugcaagagacggucuaucaaauccuuuuucagccgccucaacuggcugcaucaacuuaaguauaaguacccugcgcugaauguuacaaugcccaacaaugagaaauuugacaagcucuauauuuggggcgugcaccacccuucuaccgauuccgaccagaucagccuguacgcccaggcuuccggcagagucacggugucuacaaaacggagccagcaaaccgugauuccgaacaucgggucccgccccugggucagaggaguuagcucucggauuuccaucuacuggacaauugugaagccuggcgauauccugcucaucaacagcaccgggaaucugauugcccccagaggauauuucaaaaucagaucuggcaagagcuccauuaugcggucuaacgcuccuaucgggaaguguaauagcgaaugcauuacccccaacggauccaucccgaaugacaaaccuuuucagaacgugaaucgcaucacauacggcgccugucccagauaugucaagcagaacacgcuuaaacuggcgaccggcaugcggaaugugccugagaagcagacacgcgggauuuucggagccaucgcuggcuuuauugaaaacgggugggagggaaugguugacggcugguacggguucagacaucaaaauagcgagggaaccggccaggccgcugaucucaaaucuacacaggccgccaucaaccaaauuaauggcaagcugaaccggcuuaucgagaaaaccaaugaaaaguuucaccagaucgaaaaggaguucuccgaaguggaggggcgcauucaggaccuggagaaauaugucgaagauacgaagaucgaccucuggagcuacaacgcugagcugcugguggcgcucgaaaaccagcauacaauugaucugaccgacucugagaugaauaaacuuuucgaacgcacccggaagcaacugagagagaacgccgaggauaugggaaauggcugcuuuaaaaucuaucacaagugugacaacgcuugcauuggguccauccgcaauggaacauacgaucacgacguuuaccgggaugaagcccucaacaauagauuccagauuaagggcguggagcugaaaagcggguauaaggacuggauccuuuggaucuccuuugccauuucuugcuuccugcucugugucgugcugcugggcuuuaucaugugggcuugccagaaaggaaacauucgcuguaauaucugcauuuga

SEQ ID NO: 183123 - RNA, 1701 nt, Artificial Sequence
  derived and/or modified sequence opt5 from hemagglutinin__InfluenzaA__AAX57924
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccuuugccugcaagagacggagcauuaaaucuuucuuuucccgccucaacuggcugcaucaacuuaaguauaaguacccugcgcugaaugugacaaugcccaacaaugagaaauucgacaagcucuauaucuggggcguucaccacccuagcaccgauucugaccagauuucccuguacgcccaggcuagcggcagagugacggucuccacaaaacggucucagcaaaccgugaucccgaacauugggagccgccccugggugagaggagucuccagccggaucucuauuuacuggacaaucguuaagccuggcgauauccugcucauuaacuccaccgggaaucugaucgcuccccgcggauauuuuaaaauuagaagcggcaagucuagcaucaugcgguccaacgccccuauugggaaguguaauucugaaugcaucacccccaacggaagcaucccgaaugacaaaccuuuccagaacgugaaucgcauuacauacggcgccugucccagauaugugaagcagaacacgcuuaaacuggcgaccggcaugcggaaugucccugagaagcagacacgcgggaucuuuggagccauugcuggcuucaucgaaaacgggugggagggaaugguggacggcugguacggguuuagacaucaaaauuccgagggaaccggccaggccgcugaucucaaaagcacacaggccgccauuaaccaaaucaauggcaagcugaaccggcuuaucgagaaaaccaaugaaaaguuccaccagauugaaaaggaguucucugaaguugaggggagaauccaggaccuggagaaauauguggaagauacgaagauugaccucugguccuacaacgcugagcugcuggucgcgcucgaaaaccagcauacaaucgaucugaccgacagcgagaugaauaaacuuuuugaacgcacccggaagcaacugagagagaacgccgaggauaugggaaauggcugcuucaaaauuuaucacaagugugacaacgcuugcaucgggucuauucgcaauggaacauacgaucacgacguguaccgggaugaagcccucaacaauagauuucagaucaagggcguugagcugaaauccggguauaaggacuggauccuuuggauuagcuucgccaucuccugcuuucugcucugugugguccugcugggcuucauuaugugggcuugccagaaaggaaacauccgcuguaauauuugcaucuga

SEQ ID NO: 183124 - RNA, 1701 nt, Artificial Sequence; identical to SEQ ID NO: 183096
  derived and/or modified sequence opt5 from hemagglutinin__InfluenzaA__AAX57934

SEQ ID NO: 183125 - RNA, 1701 nt, Artificial Sequence
  derived and/or modified sequence opt5 from hemagglutinin__InfluenzaA__AAX57944
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagcgggcccugggugcgcggagucuccagcagaauuucuaucuacuggaccauuguuaaaccuggcgacauccugcucaucaacuccacagggaaucugauugcuccccggggauauuucaagauccgcagcggcaagucuagcauuaugagauccgacgccccuaucggcaaauguaacucugaaugcauuacccccaaugggagcaucccgaacggaaagccuuuucagaaugugaaccggaucaccuacggcgcuuguccccgcuaugugaaacagaauacacuuaagcuggccacggggaugagaaacgucccugagaaacaaacccggggaauuuucggcgcgaucgccggguuuauugaaaauggaugggagggcaugauggauggcugguacggguuccgccaccagaacuccgagggaacaggccaggcugccgaccucaagagcacccaagcugccaucaaucagauuaacgggaaacugaauagacuuaucgaaaagacaaacgagaaguuucaucagaucgaaaaagaguucucugaaguggagggacggauucaggaucuggagaaguauguugaagacaccaaaaucgaucucugguccuacaaugccgagcugcugguggcucucgaaaaccaacacacgauugaccugacagauagcgagaugaacaaacuuuucgaaagaaccaagaagcagcugcgcgagaaugcggaggacaugggcaacgggugcuuuaagaucuaucauaaaugugauaaugccugcauuggcucuauccggaacggaaccuacgaccacgaugucuacagagacgaagcucucaauaaccgcuuccagauuaaguccguggagcugaaaagcggcuauaaggacuggauccuuuggaucuccuuugccauuucuugcuuccugcucuguaucguucugcugggguuuauuaugugggccugccagaaaggaaauauccgguguaacauuugcaucuga

SEQ ID NO: 183126 - RNA, 1701 nt, Artificial Sequence
  derived and/or modified sequence opt5 from hemagglutinin__InfluenzaA__AAX76623
augaagaccaucauugcccugagcuacauccucugccugguguucgcucagaaacuucccggcaacgacaaguccacagccacgcugugucucgggcaccaugcggucccuaauggaaccauuguuaaaacaaucaccaacgaucaaauugaggugacaaaugcuaccgaacuggugcagucuagcuccacaggcgggaucugcgacucuccgcaccagauccuugauggagagaacuguacccugauugacgcccuccugggcgauccccagugcgacggguuucaaaauaagaaaugggaucuguucgucgaaagaagcaaggccuauuccaacuguuacccuuaugacgugcccgauuacgcuucucuccggagccugguugccuccagcggaacgcuugaguuuaauaacgaaucuuucgacuggaccggcgugacacagaauggcaccuccagcgcuugcaagcgcagaucuaacaaauccuuuuucagccggcugaauuggcucacacaucugaaguauaaauacccugcccuuaacgucaccaugcccaauaacgagaaguuugauaaacuguauaucuggggagugcaccauccugggacggacucugaucagauuucccucuacgcgcaggccagcggccgcaucacaguuuccaccaagagaucucaacagacagugauuccgaauaucgggagccggccccgcgucagagacauuuccagccggaucucuaucuacuggaccauugugaagccuggagacauccugcugauuaacuccaccggcaaccucaucgcuccccgcggguauuucaaaauuagaagcggaaagucuagcaucaugcgguccgaugccccuaucggcaaauguaauucugagugcauuacacccaacggcagcaucccgaaugacaagccuuuucagaacgugaaucgcauuacguacggggcuugucccagauaugucaaacagaacacccugaagcuggccacaggaaugcggaauguuccugaaaaacaaacccgcggcaucuucggggcgauugccggauuuaucgagaacggcugggaagggaugguggauggaugguacggcuucagacaccaaaauuccgagggcacagggcaggcugccgaccuuaagagcacccaggcugccaucaaccagauuaauggaaagcucaaccggcugaucggcaaaacgaaugagaaguuucaccagauugaaaaagaguucucugaaguggaggggagaauccaggaucuugaaaaguaugucgaggacacaaaaauugaucugugguccuacaacgccgagcuccugguggcucuggaaaaucaacauaccaucgaccucaccgauagcgagaugaacaagcuguucgaacgcacaaagaaacagcuucgggagaacgcggaagacaugggaaauggcugcuuuaagauuuaucacaaaugugauaacgccugcaucgggucuaucagaaauggcaccuacgaccaugacguuuaccgcgaugaggcucugaacaaucgguuccagauuaagggaguggagcucagauccggcuauaaagacuggauccuguggauuagcuuugccaucuccugcuuccuucugugugucgccucucucggguuuauuaugugggcuugccagaagggaaacauccgcuguaauaucugcauuuga

SEQ ID NO: 183127 - RNA, 1701 nt, Artificial Sequence
  derived and/or modified sequence opt5 from hemagglutinin__InfluenzaA__AAX76643
augaagaccaucauugcccugagcuacuuccucugccugguguuugcucagaaacuucccggcaacgacaauuccacagccacgcugugucucgggcaccaugcggucccuaacggaaccaucguuaagacaauuaccaaugaucaaaucgaggugacaaacgcuaccgaacuggugcagucuagcuccacaggcgggauuugcgacucuccgcaccagauccuugauggagagaauuguacccugaucgacgcccuccugggcgauccccagugcgacggguuccaaaacaaaaagugggaucuguuugucgaaagaagcaaagccuauuccaauuguuacccuuaugacgugcccgauuacgcuucucuccggagccugguugccuccagcggaacgcuugaguucaacaaugaaucuuuuaacuggaccggcgugacacagaauggcaccuccagcgcuugcgagcgcagaucuaacaaguccuucuuuagccggcugaauuggcucacacaucugaaguauaaauacccugcccuuaacgucaccaugcccaauaacgagaaguucgacaaacuguauauuuggggagugcaccauccugggacggauucugaccagaucucccucuacgcgcaggccagcggccgcauuacaguuuccaccaagagaucucaacagacagugaucccgaacauugggagccggccccgcgucagagauguguccagccggaucucuauuuacuggaccaucgugaaaccuggagacauccugcugauuaauuccaccggcaaccucaucgcuccccgcggguauuuuaagauuagaagcggaaagucuagcaucaugcgguccgacgccccuauuggcaaauguaauucugaaugcaucacacccaacggcagcaucccgaaugauaagccuuuccagaacgucaaucgcauuacguacggggcuugucccagauauguuaaacagaacacccugaaacuugccacaggaaugcggaaugugccugagaaacaaacccgcggcaucuuuggggcgauugccggauucaucgaaaacggcugggaggggaugguggacggaugguacggcuuuagacaccagaauagcgagggcacagggcaggcugccgaucugaaguccacccaagcugccauuaaccagaucaauggaaaacucaaccggcugaucggcaagacgaaugaaaaguuccaccagauugagaaagaguucucugaagucgaagggagaauccaggaccuugagaaguauguggaggauacaaaaauugaccugugguccuacaacgccgaacuccugguugcucuggagaaccaacauaccaucgaucucaccgacagcgaaaugaauaagcuguuugagcgcacaaagaagcagcuucgggaaaacgcggaggauaugggaaauggcugcuucaagauuuaucacaaaugugacaacgccugcaucgggucuauuagaaauggcaccuacgaucaugacguguaccgcgacgaggcucugaacaaucgguuucagaucaagggagucgaacucaaauccggcuauaaggauuggauccuguggauuagcuucgccaucuccugcuuucuucuguguguggcccuccugggguucauuaugugggcuugccagaaaggaaacaucagaugugacauuugcaucuga

SEQ ID NO: 183128 - RNA, 1701 nt, Artificial Sequence
  derived and/or modified sequence opt5 from hemagglutinin__InfluenzaA__AAX76653
augaagaccaucauugcccugagcuacuuccucugccugguguuugcucagaaacuucccggcaacgacaauuccacagccacgcugugucucgggcaccaugcggucccuaacggaaccaucguuaagacaauuaccaaugaucaaaucgaggugacaaacgcuaccgaacuggugcagucuagcuccacaggcgggauuugcgacucuccgcaccagauccuugauggagagaauuguacccugaucgacgcccuccugggcgauccccagugcgacggguuccaaaacaaaaagugggaucuguuugucgaaagaagcaaagccuauuccaauuguuacccuuaugacgugcccgauuacgcuucucuccggagccugguugccuccagcggaacgcuugaguucaacaaugaaucuuuuaacuggaccggcgugacacagaauggcaccuccagcgcuugcgagcgcagaucuaacaaguccuucuuuagccggcugaauuggcucacacaucugaaguauaaauacccugcccuuaacgucaccaugcccaauaacgagaaguucgacaaacuguauauuuggggagugcaccauccugggacggauucugaccagaucucccucuuugcgcaggccagcggccgcauuacaguuuccaccaagagaucucaacagacagugaucccgaacauugggagcggaccccggguccgcgauguguccagcagaaucucuauuuacuggaccaucgugaaaccuggcgacauccugcugauuaauuccaccgggaaccucaucgcuccccggggauacuucaagauucgcagcggcaagucuagcaucaugagauccgacgccccuauuggcaaauguaauucugaaugcaucacacccaacgggagcaucccgaaugauaagccuuuucagaacgucaaucggauuacguauggagcuuguccccgcuacguuaaacagaacacccugaaacuugccacaggcaugagaaaugugccugagaaacaaacccgggggaucuucggagcgauugccggcuuuaucgaaaacgggugggagggaaugguggacggcugguauggcuuccgccaccagaauagcgaggggacaggacaggcugccgaucugaaguccacccaagcugccauuaaccagaucaauggcaaacucaacagacugaucgggaagacgaaugaaaaguuccaccagauugagaaagaauuuucugaggucgaaggacggauccaggaccuugagaaguacguggaggauacaaaaauugaccugugguccuauaacgccgaacuccugguugcucuggagaaccaacauaccaucgaucucaccgacagcgaaaugaauaagcuguucgagagaacaaagaagcagcuucgcgaaaacgcggaggauaugggcaaugggugcuuuaagauuuaccacaaaugugacaacgccugcaucggcucuauucggaauggaaccuaugaucaugacguguacagagacgaggcucugaacaaucgcuuccagaucaagggcgucgaacucaaauccggguacaaggauuggauccuguggauuagcuuugccaucuccugcuuccuucuguguguggcccuccugggauuuauuaugugggcuugccagaaaggcaacauccggugugacauuugcaucuga

SEQ ID NO: 183129 - RNA, 1701 nt, Artificial Sequence
  derived and/or modified sequence opt5 from hemagglutinin__InfluenzaA__AAX76663
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagcgggcccugggugcgcggagucuccagcagaauuucuaucuacuggaccauuguuaaaccuggcgacauccugcucaucaacuccacagggaaucugauugcuccccggggauauuucaagauccgcagcggcaagucuagcauuaugagauccgacgccccuaucggcaaauguaacucugaaugcauuacccccaaugggagcaucccgaacgauaagccuuuucagaaugugaaccggaucaccuacggacccuguccucgcuaugugaaacagaauacacuuaagcuggcuacgggcaugagaaacguccccgagaaacaaacccgggggauuuucggagccaucgcgggcuuuauugaaaaugggugggagggaaugauggacggcugguacggcuuccgccaccagaacuccgaggggacaggacaggccgcugaucucaagagcacccaagccgcuaucaaucagauuaacggcaaacugaauagacuuaucgaaaagacaaacgagaaguuucaucagaucgaaaaagaguucucugaaguggaggggcggauucaggaccuggagaaguauguugaagauaccaaaaucgaccucugguccuacaaugccgagcugcugguggcccucgaaaaccaacacacgauugaucugacagacagcgagaugaacaaacuuuucgaaagaaccaagaagcagcugcgcgagaaugcugaggauaugggaaacggcugcuuuaagaucuaucauaaaugugacaaugcgugcauugggucuauccggaacggcaccuacgaucacgacgucuacagagacgaagcccucaauaaccgcuuccagauuaagggaguggagcugaaauccggcuauaaggauuggauccuuuggaucagcuuugcuauuuccugcuuccugcucuguaucguucugcugggguuuauuaugugggccugccagaaaggaaauauccgguguaacauuugcaucuga

SEQ ID NO: 183130 - RNA, 1701 nt, Artificial Sequence
  derived and/or modified sequence opt5 from hemagglutinin__InfluenzaA__AAX76673
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugguggacggcugguacggguucagacaucaaaauagcgagggaaccggccaggccgcugaucucaaaucuacacaggccgccauuaaccaaaucaauggcaagcugaaccggcuuaucgaaaagaccaaugagaaguuucaccagauugaaaaggaguucuccgaaguugaggggagaauccaggaccuggagcgcuauguggaagauacgaaaauugaccucuggagcuacaacgcugagcugcuggucgcgcucgaaaaccagcauacaaucgaucugaccgacucugagaugaauaaacuuuucgaacggaccagaaaacaacugcgcgagaacgccgaggauaugggaaauggcugcuuuaagauuuaucacaaaugugacaacgcuugcaucggguccauucggaauggaacauacgaucacgacguguacagagaugaagcccucaacaaucgcuuccagaucaagggcguugagcuuaagagcggguauaaagacuggauccuguggauuuccuuugccaucucuugcuuccugcucugugugguccugcugggcuuuauuaugugggcuugccagaagggaaacauccgguguaauauuugcaucuga

SEQ ID NO: 183131 - RNA, 1701 nt, Artificial Sequence
  derived and/or modified sequence opt5 from hemagglutinin__InfluenzaA__AAX76683
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcccccagaggauauuucaaaauuagaucuggcaagagcuccgugaugcggucuaacgcuccuaucgggaaguguaauagcgaaugcauuacccccaacggauccaucccgaaugacaaaccuuuucagaacgugaaucgcaucacauacggcgccugucccagauaugucaagcagaacacgcuuaaacuggcgaccggcaugcggaaugugccugagaagcagacacgcgggauuuucggagccaucgcuggcuuuauugaaaacgggugggagggaaugguugacggcugguacggguucagacaucaaaauagcgagggaaccggccaggccgcugaucucaaaucuacacaggccgccaucaaccaaauuaauggcaagcugaaccggcuuaucgagaaaaccaaugaaaaguuucaccagaucgaaaaggaguucuccgaaguggaggggcgcauucaggaccuggagaaauaugucgaagauacgaagaucgaccucuggagcuacaacgcugagcugcugguggcgcucgaaaaccagcauacaauugaucugaccgacucugagaugaauaaacuuuucgaacgcacccggaagcaacugagagagaacgccgaggauaugggaaauggcugcuuuaaaaucuaucacaagugugacaacgcuugcauuggguccauccgcaauggaacauacgaucacgacguuuaccgggaugaagcccucaacaauagauuccagauuaagggcguggagcugaaaagcggguauaaggacuggauccuuuggaucuccuuugccauuucuugcuuccugcucugugucgugcugcugggcuuuaucaugugggcuugccagaaaggaaacauucgcuguaauaucugcauuuga

SEQ ID NO: 183132 - RNA, 1701 nt, Artificial Sequence; identical to SEQ ID NO: 183096
  derived and/or modified sequence opt5 from hemagglutinin__InfluenzaA__AAX76713

SEQ ID NO: 183133 - RNA, 1701 nt, Artificial Sequence
  derived and/or modified sequence opt5 from hemagglutinin__InfluenzaA__AAX76723
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugaggaauuugacaaacucuauaucuggggcguucaccacccuucuaccgauuccgaccagauuagccuguacgcccaggcuuccggcagagugacggucucuacaaagcggagccagcaaaccgugaucccgaacauugggucccgccccugggugagaggagucagcucuaucauuuccaucuacuggacaaucguuaaaccuggcgauauucugcucaucaacagcaccgggaaucugauugcuccccggggauauuucaagauccgcucuggcaaaagcuccauuaugagaucuaacgccccuaucgggaaguguaauagcgagugcaucacccccaacggauccauuccgaaugacaagccuuuucagaacgugaaucggaucacauacggcgccuguccccgcuaugugaaacagaacacgcuuaagcuggcgaccggcaugagaaaugucccugaaaaacagacacgggggauuuucggagccaucgcuggcuuuauugagaacgggugggagggaaugguggacggcugguacggguuccgccaucaaaauagcgaaggaaccggccaggccgcugaucucaagucuacacaggccgccaucaaccaaaucaauggcaaacugaacagacuuauugagaagaccaaugaaaaauuucaccagaucgagaaggaguucuccgaaguugaggggcggauucaggaccuggaaaaguauguggaggauacgaaaaucgaccucuggagcuacaacgcugaacugcuggucgcgcucgagaaccagcauacaauugaucugaccgacucugaaaugaauaagcuguucgagagaacccgcaaacaacugcgggagaacgccgaagauaugggaaauggcugcuuuaagaucuaucacaaaugugacaacgcuugcauuggguccaucagaaauggaacauacgaucacgacguguaccgcgaugaggcccucaacaaucgguuccagaucaagggcguugaacuuaagagcggguauaaagacuggauucuuuggaucuccuuugccauuucuugcuuccugcucugugugguccugcugggcuuuaucaugugggcuugccagaagggaaacauuagauguaauaucugcaucuga

SEQ ID NO: 183134 - RNA, 1701 nt, Artificial Sequence
  derived and/or modified sequence opt5 from hemagglutinin__InfluenzaA__AAX76733
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacagacagaauuugcgauucuccgcaccagauccuggacggcgggaauuguacccucaucgaugcccugcugggagacccccauugcgauggcuuucagaacaaagagugggaccucuucgucgaacggagcaaggccuauuccaauuguuacccuuaugaugugcccgacuacguuucucugcgcagccuuguggcuuccagcgggacgcuggaguuuaacaaugaaucuuucaacuggaccggagucgcccaaaauggcacauccagcgcuugcaaaagacggucugauaaguccuuuuucagccgccucaacuggcugcaccagcuuaagaauaaauauccugcccugaacguggcgaugcccaauaacgagaaguuugacaaacucuacauuuggggcguucaucacccugggaccgauucugaccagaucucccuguaugcccaggcuagcggaagagugacagucuccaccaagcggucucaacagacggugauuccgaacaucggcagccgccccagagugcgggacauuuccagccgcaucucuauuuacuggacaaucgucaaaccuggggauauccugcucauuaauuccaccggaaaccugaucgcccccagaggcuacuucaagauucggagcgggaagucuagcaucaugcgcuccgacgcuccuauuggaaaauguaauucugagugcaucacacccaacggcagcaucccgaaugauaagccuuuucagaacguuaauagaauuaccuauggcgccuguccccgguacgugaaacagaacacccuuaagcuggcgacagggaugcgcaaugugccugaaaaacaaacgagaggaaucuucggcgccauugcuggguuuaucgagaacggaugggaaggcauggucgacgggugguauggauuccggcaccagaauuacgagggcaccggccaggccgcugaucucaaguccacacaagccgccauuaaccagaucaaugggaaacugaacagacuuaucgagaagaccaaugaaaaguuucaucagauugagaaagaguucagcgaaguggaaggacgcauccaggaccuggagaaguauguugaggauacaaaaauugaccucuggucuuacaacgcugaacugcugguggcgcucgagaaccaacacaccaucgaucugacggacuccgaaaugaauaaacuuuucgagcggacaaagaagcagcugagagaaaacgccgaggauaugggcaaugggugcuuuaagauuuaucauaaaugugacaacgcuugcaucggaagcauucgcaauggcaccuacgaccacgaugucuaccgggacgaggcccucaacaauagauuccagaucaaggggguggaacugaaaucuggcuauaaggauuggauccuuuggauuuccuuugccaucagcugcuuccugcucuguauuguucugcugggauuuaucaugugggcuugccagaaaggcaacauucgcuguaauaucugcaucuga

SEQ ID NO: 183135 - RNA, 1701 nt, Artificial Sequence
  derived and/or modified sequence opt5 from hemagglutinin__InfluenzaA__AAX76743
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucuaacaaguccuuuuucagccgccucaauuggcugcaccagcuuaagaacaaauauccugcccugaauguggcgaugcccaacaacgagaaguuugacaaacucuacauuuggggcguucaucacccugggaccgauucugaccagaucucccuguaugcccaggcuagcggaagagugacagucuccaccaagcggucucaacagacggugauuccgaauaucggcagccgccccagagugcgggauauuuccagccgcaucucuauuuacuggacaaucgucaaaccuggggacauccugcucauuaacuccaccggaaaucugaucgcccccagaggcuacuucaagauucggagcgggaagucuagcaucaugcgcuccgacgcuccuauuggaaaauguaacucugaaugcaucacacccaauggcagcaucccgaacgauaagccuuuucagaauguuaacagaauuaccuauggcgccuguccccgguacgugaaacagaauacccuuaagcuggcgacagggaugcgcaacgugccugagaaacaaacgagaggaaucuucggcgccauugcuggguuuaucgaaaauggaugggagggcaugauggacgggugguauggauuccggcaccagaacuccgagggcaccggccaggccgcugaucucaagagcacacaagccgccauuaaucagaucaacgggaaacugaauagacuuaucgaaaagaccaacgagaaguuucaucagauugaaaaagaguucucugaagucgagggacgcauccaggaccuggagaaguacguggaagauacaaaaauugaccucugguccuauaacgcugagcugcugguugcgcucgaaaaucaacacaccaucgaucugacggacagcgagaugaacaaacuuuucgaacggacaaagaagcagcugagagagaaugccgaggauaugggcaacgggugcuuuaagauuuaccauaaaugugacaaugcuugcaucggaucuauucgcaacggcaccuaugaucacgacguguaccgggacgaagcccucaauaacagauuccagaucaagggggucgagcugaaauccggcuacaaggauuggauccuuuggauuagcuuugccaucuccugcuuccugcucuguauugugcugcugggauuuaucaugugggcuugccagaaaggcaauauucgcuguaacaucugcaucuga

SEQ ID NO: 183136 - RNA, 1701 nt, Artificial Sequence
  derived and/or modified sequence opt5 from hemagglutinin__InfluenzaA__AAX76763
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacauuuccagccggaucucuaucuacuggaccauugugaagccuggagacauccugcugauuaacuccaccggcaaucucaucgcuccccgcggguauuucaagauuagaagcggaaaaucuagcaucaugcgguccgaugccccuaucggcaaguguaacucugagugcauuacacccaauggcagcaucccgaacgacaaaccuuuucagaaugugaaccgcauuacguacggggcuugucccagauaugucaagcagaauacccugaaacuugccacaggaaugcggaacguuccugaaaagcaaacccgcggcaucuucggggcgauugccggauuuaucgagaauggcugggaagggaugguggauggaugguacggcuucagacaccagaacuccgagggcacagggcaggcugccgaccugaaaagcacccaagcugccaucaaucagauuaacggaaagcucaaucggcugaucggcaagacgaacgagaaauuucaccagauugaaaaggaguucucugaaguggaggggagaauccaggaucuugaaaaauaugucgaggacacaaagauugaucugugguccuacaaugccgagcuccugaucgcucuggaaaaccaacauaccauugaccucaccgauagcgagaugaacaaacuguucgaacgcacaaagaagcagcuucgggagaaugcggaagacaugggaaacggcugcuuuaaaaucuaucacaagugugauaaugccugcaucgggucuauuagaaacggcaccuacgaccaugacguguaccgcgaugaggcucugaauaaccgguuccagaucaaaggaguugagcucaaguccggcuauaaagacuggauucuguggaucagcuuugccauuuccugcuuccuucuguguguggcccuccugggguuuaucaugugggcuugccagaagggaaauaucagauguaacauuugcaucuga

SEQ ID NO: 183137 - RNA, 1701 nt, Artificial Sequence; identical to SEQ ID NO: 183056
  derived and/or modified sequence opt5 from hemagglutinin__InfluenzaA__AAY18086

SEQ ID NO: 183138 - RNA, 1701 nt, Artificial Sequence
  derived and/or modified sequence opt5 from hemagglutinin__InfluenzaA__AAY18096
augaagaccaucauugcccugagcugcauccucugucugguguucgcucagaaacuucccggcaacgacaauuccacagccacgcugugccucgggcaccaugcggucccuaacggaaccauuguuaagacaaucaccaaugaucaaauugaggugacaaacgcuaccgaacuggugcagucuagcuccacaggcgggaucugugacucuccgcaccagauccuugauggagagaauugcacccugauugacgcccuccugggcgauccccagugugacggguuucaaaacaaaaagugggaucuguucgucgaaagaagcaaagccuacuccaauugcuauccuuacgacgugcccgauuaugcuucucuccggagccugguugccuccagcggaacgcuugaguuuaacaaugaaucuuucaacuggaccggcgugacacagaauggcaccuccagcgcuugugagcgcagaucuaacaaguccuuuuucagccggcugaauuggcucacacaucugaaguacaaauauccugcccuuaacgucaccaugcccaauaacgagaaguuugacaaacuguacaucuggggagugcaccauccugggacggauucugaccagauuucccucuaugcgcaggccagcggccgcaucacaguuuccaccaagagaucucaacagacagugauuccgaacaucgggagccggccccgcgucagagauguguccagccggauuucuaucuacuggaccaucgugaaaccuggagacauucugcugaucaauuccaccggcaaccucauugcuccccgcggguacuucaagaucagaagcggaaagucuagcauuaugcgguccgacgccccuaucggcaaaugcaauucugaauguaucacacccaacggcagcauuccgaaugauaagccuuuucagaacgucaaucgcaucacguauggggcuugccccagauacguuaaacagaacacccugaaacuugccacaggaaugcggaaugugccugagaaacaaacccgcggcauuuucggggcgaucgccggauuuauugaaaacggcugggaggggaugguggacggaugguauggcuucagacaccagaauagcgagggcacagggcaggcugccgaucugaaguccacccaagcugccaucaaccagaucaauggaaaacucaaccggcugauuggcaagacgaaugaaaaguuucaccagaucgagaaagaguucucugaagucgaagggcgcauucaggaccuugagaaguacguggaggauacaaaaaucgaccugugguccuauaacgccgaacuccugguugcucuggagaaccaacauaccauugaucucaccgacagcgaaaugaauaagcuguucgagagaacaaagaagcagcuucgggaaaacgcggaggauaugggaaauggcuguuuuaagaucuaccacaaaugcgacaacgccugcauugggucuaucagaaauggcaccuaugaucaugacguguaccgcgacgaggcucugaacaaucgguuccagaucaagggagucgaacucaaauccggcuacaaggauuggauucuguggaucagcuuugccauuuccuguuuccuucugugcguggcccuccugggguuuaucaugugggcuugucagaaaggaaacauuagaugcgacaucuguaucuga

SEQ ID NO: 183139 - RNA, 1701 nt, Artificial Sequence; identical to SEQ ID NO: 183071
  derived and/or modified sequence opt5 from hemagglutinin__InfluenzaA__AAY18106

SEQ ID NO: 183140 - RNA, 1701 nt, Artificial Sequence; identical to SEQ ID NO: 183071
  derived and/or modified sequence opt5 from hemagglutinin__InfluenzaA__AAY18116

SEQ ID NO: 183141 - RNA, 1701 nt, Artificial Sequence
  derived and/or modified sequence opt5 from hemagglutinin__InfluenzaA__AAY18126
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaggcuucaacuggaccggcgugacacagaaugggaccucuuccgcuugcaagcgcaagagcaacaaauccuuuuucucuagacugaauuggcucacacaucugaaguauaaauacccugcccuuaacgucaccaugcccaauaacgagaaguuugacaaacuguauaucuggggagugcaccauccuggcacggauaacgaccagauuagccucuacgcgcaggccucugggcggaucacaguuuccaccaagcgcagccaacagacagugauuccgaauaucggauccagaccccggguccgcgaugugucuagcagaauuuccaucuacuggaccaucgugaagccuggcgacauucugcugaucaacagcaccgggaaucucauugcuccccggggauauuucaaaauccgcucuggcaaguccagcauuaugagaucugacgccccuaucggcaaauguaacagcgagugcaucacacccaauggguccauuccgaacgauaagccuuuucagaaugucaaccggaucacguacggagcuuguccccgcuauguuaaacagaauacccugaagcuggccacaggcaugagaaacgugccugaaaaacaaacccgggggauuuucggagcgaucgccggcuuuauugagaaugggugggaaggaaugguggacggcugguacggcuuccgccaccagaacucugaggggacaggacaggcugccgaucuuaagagcacccaagcugccaucaaucagaucaacggcaagcucaauagacugauugggaaaacgaacgagaaguuucaccagaucgaaaaagaguucuccgaagucgagggacggauucaggaccuugaaaaguauguggaggauacaaaaaucgaccuguggagcuacaacgccgagcuccugguugcucuggaaaaucaacauaccauugaucucaccgacucugagaugaacaagcuguucgaaagaacaaagaaacagcuucgcgagaaugcggaagauaugggcaacgggugcuuuaagaucuaucacaaaugugacaaugccugcauuggcuccauccggaacggaaccuacgaucaugacguguacagagacgaggcucugaauaaccgcuuccagaucaagggcgucgagcucaaaagcggguauaaggauuggauucuguggaucucuuuugccauuuccugcuuccuucuguguguggcccuccugggauuuaucaugugggcuugccagaagggcaauauucgguguaacaucugcaucuga

SEQ ID NO: 183142 - RNA, 1701 nt, Artificial Sequence
  derived and/or modified sequence opt5 from hemagglutinin__InfluenzaA__AAY18136
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauauuaagcagaauacccugaaacuugccacaggaaugcggaacguuccugaaaagcaaacccgcggcaucuucggggcgauugccggauuuaucgagaauggcugggaagggaugguggauggaugguacggcuucagacaccagaacuccgagggcacagggcaggcugccgaccugaaaagcacccaagcugccaucaaucagauuaacggaaagcucaaucggcugaucggcaagacgaacgagaaauuucaccagauugaaaaggaguucucugaaguggaggggagaauccaggaucuugaaaaauaugucgaggacacaaagauugaucugugguccuacaaugccgagcuccugguggcucuggaaaaccaacauaccaucgaccucaccgauagcgagaugaacaaacuguucgaacgcacaaagaagcagcuucgggagaaugcggaagacaugggaaacggcugcuuuaaaauuuaucacaagugugauaaugccugcaucgggucuaucagaaacggcaccuacgaccaugacguuuaccgcgaugaggcucugaauaaccgguuccagauuaaaggaguggagcucaaguccggcuauaaagacuggauccuguggauuagcuuugccaucuccugcuuccuucugugugucgcccuccugggguuuauuaugugggcuugccagaagggaaauaucagauguaacaucugcauuuga

SEQ ID NO: 183143 - RNA, 1701 nt, Artificial Sequence; identical to SEQ ID NO: 183096
  derived and/or modified sequence opt5 from hemagglutinin__InfluenzaA__AAY18156

SEQ ID NO: 183144 - RNA, 1701 nt, Artificial Sequence; identical to SEQ ID NO: 183096
  derived and/or modified sequence opt5 from hemagglutinin__InfluenzaA__AAY18176

SEQ ID NO: 183145 - RNA, 1701 nt, Artificial Sequence; identical to SEQ ID NO: 183096
  derived and/or modified sequence opt5 from hemagglutinin__InfluenzaA__AAY18186

SEQ ID NO: 183146 - RNA, 1701 nt, Artificial Sequence; identical to SEQ ID NO: 183097
  derived and/or modified sequence opt5 from hemagglutinin__InfluenzaA__AAY18564

SEQ ID NO: 183147 - RNA, 1701 nt, Artificial Sequence
  derived and/or modified sequence opt5 from hemagglutinin__InfluenzaA__AAY18585
augaagaccaucauugcccugagcuacauccucugccugguguucgcucagaaacuucccgagaacgacaauuccacagccacgcugugucucggccaccaugcggucccuaacgggacccugguuaagacaauuaccaaugaucaaaucgaagugacaaacgcuaccgagcuugugcagucuagcuccacaggaagaauuugcgacucuccgcaccagauccuggauggcgaaaauuguacccucaucgacgcccugcugggggauccccauugcgacggauuucagaacaaagagugggaucucuucgucgaacggagcaaggccuauuccaauuguuacccuuaugacgugcccgauuacguuucucugcgcagccuuguggcuuccagcggcacgcuggaguuuaacaaugagucuuucaacuggaccggggucgcccaaaauggaacauccagcgcuugcaaaagacggucugacaaguccuuuuucagccgccucaacuggcugcaccagcuuaaguauaaauacccugcccugaaugugaccaugcccaacaaugaaaaguuugauaaacucuauauuuggggcguucaucacccuggcacagacucugaucagaucucccuguacgcgcaggccagcgggagagugaccgucuccacgaagcggucucaacagacagugauuccgaacaucggaagccgccccugggugagaggcgucuccagccggauuucuaucuacuggaccauuguuaaaccuggggacauccugcucaucaacuccacaggaaaucugauugcuccccgcggcuauuucaagaucagaagcgggaagucuagcauuaugcgguccgacgccccuaucggaaaauguaacucugagugcauuacccccaauggcagcaucccgaacgauaagccuuuucagaaugugaaccgcaucaccuacggccccuguccuagauaugugaaacagaauacacuuaagcuggcuacggggaugcggaacguccccgaaaaacaaacccgcggaauuuucggcgccaucgcgggguuuauugagaauggaugggagggcaugauggacgggugguacggauucagacaccagaacuccgaaggcacaggccaggccgcugaucucaagagcacccaagccgcuaucaaucagauuaacgggaaacugaaucggcuuaucgagaagacaaacgaaaaguuucaucagaucgagaaagaguucucugaaguggagggacgcauucaggaccuggaaaaguauguugaggauaccaaaaucgaccucugguccuacaaugccgaacugcugguggcccucgagaaccaacacacgauugaucugacagacagcgaaaugaacaaacuuuucgagagaaccaagaagcagcugcgggagaaugcugaagauaugggcaacgggugcuuuaagaucuaucauaaaugugacaaugcgugcauuggaucuaucagaaacggcaccuacgaucacgacgucuaccgcgacgaggcccucaauaaccgguuccagauuaaggggguggaacugaaauccggcuauaaggauuggauccuuuggaucagcuuugcuauuuccugcuuccugcucuguaucguucugcugggauuuauuaugugggccugccagaaaggcaauaucagauguaacauuugcaucuga

SEQ ID NO: 183148 - RNA, 1701 nt, Artificial Sequence; identical to SEQ ID NO: 183056
  derived and/or modified sequence opt5 from hemagglutinin__InfluenzaA__AAY18611

SEQ ID NO: 183149 - RNA, 1701 nt, Artificial Sequence; identical to SEQ ID NO: 183097
  derived and/or modified sequence opt5 from hemagglutinin__InfluenzaA__AAY27843

SEQ ID NO: 183150 - RNA, 1701 nt, Artificial Sequence; identical to SEQ ID NO: 183056
  derived and/or modified sequence opt5 from hemagglutinin__InfluenzaA__AAY27853

SEQ ID NO: 183151 - RNA, 1701 nt, Artificial Sequence
  derived and/or modified sequence opt5 from hemagglutinin__InfluenzaA__AAY27863
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagaucauugauggagagaauuguacccuuaucgacgcccugcucggcgauccccagugcgacggguuucaaaacaaaaagugggaucuguucgucgaaagaagcaaagccuauuccaauuguuacccuuaugacgugcccgauuacgcuucucugcggagccucguugccuccagcggaacgcuggaguuuaacaaugaaucuuucgacuggaccggcgugacacagaacggcaccuccagcgcuugcaagcgcagaucuaauaaguccuuuuucagccggcuuaacuggcugacacaucucaaauauaaguacccugcccugaaugucaccaugcccaacaaugagaaauuugauaaacuuuauauuuggggagugcaccauccugggacggacucugaucagaucucccuguacgcgcaggccagcggccgcauuacaguuuccaccaagagaucucaacagacagugaucccgaacauugggagccggccccgcgucagagacguguccagccggaucucuaucuacuggaccauugugaagccuggagacauccuccugauuaacuccaccggcaaucugaucgcuccccgcggguauuucaagauuagaagcggaaaaucuagcaucaugaucuccgaugccccuauuggcaaguguaacucugagugcaucacacccaauggcagcauuccgaacgacaaaccuuuucagaaugucaaccggaucacguacggggcuuguccccgcuauguuaagcagaauacccucaaacuggccacaggaaugagaaacgugccugaaaagcaaacccggggcauuuucggggcgaucgccggauuuaucgagaauggcugggaagggaugguggauggaugguacggcuuccgccaccagaacuccgagggcacagggcaggcugccgaccuuaaaagcacccaagcugccauuaaucagaucaacggaaagcugaauagacucauuggcaagacgaacgagaaauuucaccagaucgaaaaggaguucucugaagucgaggggcggauucaggaucuggaaaaauauguggaggacacaaagaucgaucuuugguccuacaaugccgagcugcucguugcucuggaaaaccaacauaccauugaccugaccgauagcgagaugaacaaacucuucgaaagaacaaagaagcagcugcgcgagaaugcggaagacaugggaaacggcugcuuuaaaaucuaucacaagugugauaaugccugcaucgggucuauucggaacggcaccuacgaccaugacguguacagagaugaggcucuuaauaaccgcuuccagaucaaaggagucgagcugaaguccggcuauaaagacuggauucucuggaucagcuuugccauuuccugcuuccugcuuuguguggcccugcucggguuuaucaugugggcuugccagaagggaaauauccgguguaacauuugcaucuga

SEQ ID NO: 183152 - RNA, 1701 nt, Artificial Sequence; identical to SEQ ID NO: 183075
  derived and/or modified sequence opt5 from hemagglutinin__InfluenzaA__AAY27959

SEQ ID NO: 183153 - RNA, 1701 nt, Artificial Sequence; identical to SEQ ID NO: 183055
  derived and/or modified sequence opt5 from hemagglutinin__InfluenzaA__AAY27994

SEQ ID NO: 183154 - RNA, 1701 nt, Artificial Sequence; identical to SEQ ID NO: 183055
  derived and/or modified sequence opt5 from hemagglutinin__InfluenzaA__AAY28004

SEQ ID NO: 183155 - RNA, 1701 nt, Artificial Sequence; identical to SEQ ID NO: 183055
  derived and/or modified sequence opt5 from hemagglutinin__InfluenzaA__AAY28265

SEQ ID NO: 183156 - RNA, 1701 nt, Artificial Sequence
  derived and/or modified sequence opt5 from hemagglutinin__InfluenzaA__AAY28275
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcuccccgcggcuauuucaagaucagaucugggaagucuuccguuaugcggucugacgccagcauuggaaaauguaauuccgaaugcaucaccccuaacggcagcauucccaaugacaagccguuucagaacgugaaucgcaucaccuacggcgccuguccuagauaugugaaacagaacacacuuaagcuggcgacggggaugcggaauguccccgagaaacaaacccgcggaaucuucggcgccauugcuggguuuaucgaaaacggaugggagggcaugguggaugggugguacggauucagacaccagaauagcgagggcacaggccaggccgcugaccucaaguccacccaagccgccauuaaccagaucaaugggaaacugaaccggcuuauugaaaagacaaaugagaaguuucaucagaucgaaaaagaguucagcgaaguugagggaagaauccaggaucuggagaaguauguggaagacaccaaaauugaucucuggucuuacaacgcugagcugcuggucgcgcucgaaaaccaacacacgaucgaccugacagauuccgagaugaauaaacuuuucgaacgcaccaagaagcagcugcgggagaacgccgaggacaugggcaaugggugcuuuaagauuuaucauaaaugugauaacgcuugcaucggaagcauuagaaauggcaccuacgaccacgauguguaccgcgacgaagcccucaacaaucgguuccagaucaaggggguugagcugaaauccggcuauaaggacuggauucuuuggaucucuuuugccaucagcugcuuccugcucugugugguccugcugggauuuauuaugugggcuugccagaaaggcaacaucagauguaauauuugcaucuga

SEQ ID NO: 183157 - RNA, 1701 nt, Artificial Sequence
  derived and/or modified sequence opt5 from hemagglutinin__InfluenzaA__AAY28285
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuagcacaggcagaauuugcgacuccccgcaccagauccuggauggggagaacuguacccucaucgacgcccugcugggagauccccauugcgacggcuuucagaauaaagaaugggaucucuucgucgagcggucuaaggccuauagcaacuguuacccuuaugacgugcccgauuacguuucccugcgcucucuuguggcuagcuccgggacgcuggaauuuaauaacgagagcuucaauuggaccggagucgcccagaacggcacaucuuccgcuugcaaaagacggagcgacaaguccuuuuucucucgccucaauuggcugcaccagcuuaaguauaaauacccugcccugaacgugaccaugcccaauaacgagaaguuugauaaacucuauauuuggggcguucaucacccugggacagacaacgaucagaucagccuguacgcgcaggccucuggaagagugaccgucuccacgaagcggagccaacagacagugauuccgaauaucggcucccgccccugggugagaggggucucuagccggauuuccaucuacuggaccauuguuaaaccuggagacauccugcucaucaacagcacaggcaaucugauugcuccccgcggguauuucaagaucagaucuggaaaguccagcauuaugcggucugacgccccuaucggcaaauguaacagcgaaugcauuacccccaauggcuccaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacucugagggcacagggcaggccgcugaucucaagagcacccaagccgcuaucaaucagauuaacggaaaacugaaucggcuuaucgaaaagacaaacgagaaguuucaucagaucgaaaaagaguucuccgaaguggagggccgcauucaggaccuggagaaguauguugaagauaccaaaaucgaccucuggagcuacaacgccgagcugcugguggcccucgaaaaucaacacacgauugaucugacagacucugagaugaacaaacuuuucgaaagaaccaagaagcagcugcgggagaaugcugaggauauggggaacggaugcuuuaagaucuaucauaaaugugacaaugcgugcauuggcuccaucagaaacgggaccuacgaucacgacgucuaccgcgacgaagcccucaauaaccgguuccagauuaagggcguggagcugaaaagcggauauaaggauuggauccuuuggaucucuuuugcuauuuccugcuuccugcucuguaucguucugcugggcuuuauuaugugggccugccagaaagggaauaucagauguaacauuugcaucuga

SEQ ID NO: 183158 - RNA, 1701 nt, Artificial Sequence
  derived and/or modified sequence opt5 from hemagglutinin__InfluenzaA__AAY28295
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggcaaaaucacaguuuccaccaagcgcucucaacagacagugauuccgaacaucgggagcagaccccggguccgcgacguguccagcagaauuucuaucuacuggaccaucgugaagccuggagacauucugcugaucaacuccaccggcaaucucauugcuccccggggguauuucaaaauccagagcggaaagucuagcauuaugcgcuccgaugccccuaucggcaaauguaacucugagugcaucacacccaauggcagcauuccgaacgacaagccuuuucagaaugucaacagaaucacguacggggcuuguccccgguauguuaaacaaaagacccugaaacuugccacaggaaugcgcaaugugccugaaaagcagaccagaggcauuuucggggcgaucgccggauuuauugagaacggcugggaagggaugguggauggaugguacggcuuccggcaccaaaauuccgagggcacagggcaggcugccgaccugaaaagcacccaggcugccaucaaccagaucaauggaaaacucaaccgccugauuggcaagacgaaugagaaauuucaccagaucgaaaaggaguucucugaagucgaggggcggauucaagaucuugaaaaauauguggaggacacaaagaucgaucugugguccuacaacgccgagcuccugguugcucuggaaaaucagcauaccauugaccucaccgauagcgagaugaacaagcuguucgaaagaacaaagaagcagcuuagagagaacgcggaagacaugggaaauggcugcuuuaaaaucuaucacaagugugauaacgccugcauugggucuauccgcaauggcaccuacgaccaugacguguaccgggaugaggcucugaacaauagauuccagaucaaaggagucgagcucaaguccggcuauaaggacuggauucuguggaucagcuuugccauuuccugcuuccuucuguguguggcccuccugggguuuaucaugugggcuugccaaaaaggaaacauucgcuguaauaucugcaucuga

SEQ ID NO: 183159 - RNA, 1701 nt, Artificial Sequence
  derived and/or modified sequence opt5 from hemagglutinin__InfluenzaA__AAY28305
augaaggccaucauugcucugagcuacauccucugccugguguucgcccagaaacuucccggcaacgacaauuccaccgcgacacugugucucgggcaccaugcugucccuaacggaacgcugguuaagaccauuacaaaugaucaaaucgaggugaccaacgccacagaacuugugcagucuagcuccaccggcagaauuugcgacucuccgcaccagauccuggauggggagaauuguacacucaucgacgcccugcugggagauccccauugcgacggcuuucagaacaaagaaugggaucucuucgucgagcggagcaaggcuuauuccaauuguuacccuuaugacgugcccgauuacguuucucugcgcagccuuguggccuccagcgggacccuggaauuuaacaaugagucuuucaacuggacgggagucgcucaaaauggcaccuccagcgccugcaaaagacggucugacaaguccuuuuucagccgccucaacuggcugcaccagcuuaaguauaaauacccugcgcugaaugugacaaugcccaacaaugagaaguuugauaaacucuauauuuggggcguucaucacccugggaccgacucugaucagaucucccuguacgcccaggcuagcggaagagugacagucuccaccaagcggucucaacagacggugauuccgaacaucggcagcgggcccugggugcgcggagucuccagcagaauuucuaucuacuggacaauuguuaaaccuggcgacauccugcucaucaacuccaccgggaaucugauugcuccccggggauauuucaagauccgcagcggcaagucuagcauuaugagauccgacgccccuaucggcaaauguaacucugaaugcauuacacccaaugggagcaucccgaacgauaagccuuuucagaaugugaaccggaucaccuacggagccuguccccgcuaugugaaacagaauacccuuaagcuggcgacaggcaugagaaacgucccugagaaacaaacgcgggggauuuucggagccaucgcuggcuuuauugaaaaugggugggagggaaugauggacggcugguacggcuuccgccaccagaacuccgaggggaccggacaggccgcugaucucaagagcacacaagccgccaucaaucagauuaacggcaaacugaauagacuuaucgaaaagaccaacgagaaguuucaucagaucgaaaaagaguucucugaaguggaggggcggauucaggaccuggagaaguauguugaagauacaaaaaucgaccucugguccuacaaugcugagcugcugguggcgcucgaaaaccaacacaccauugaucugacggacagcgagaugaacaaacuuuucgaaagaacaaagaagcagcugcgcgagaaugccgaggauaugggaaacggcugcuuuaagaucuaucauaaaugugacaaugcuugcauugggucuauccggaacggcaccuacgaucacgacgucuacagagacgaagcccucaauaaccgcuuccagauuaagggaguggagcugaaauccggcuauaaggauuggauccuuuggaucagcuuugccauuuccugcuuccugcucuguaucguucugcugggguuuauuaugugggcuugccagaaaggaaauauccgguguaacauuugcaucuga

SEQ ID NO: 183160 - RNA, 1701 nt, Artificial Sequence
  derived and/or modified sequence opt5 from hemagglutinin__InfluenzaA__AAY28325
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugauugucucuaccaagcggagccaacagacggugaucccgaacauuggauccggccccugggugcgcggggucagcucuagaaucuccauuuacuggacaaucguuaaaccuggagacauccugcucauuaacagcaccggcaaucugaucgcuccccggggguauuucaagauucgcucuggaaagagcuccaucaugagaucugacgccccuauuggcaaauguaacagcgaaugcaucacacccaauggcuccaucccgaacgauaagccuuuucagaaugugaaccggauuaccuacggggcuuguccccgcuaugugaaacagaauacccuuaagcuggccacaggaaugagaaacgucccugagaaacaaacgcggggcaucuucggggcgauugccggauuuaucgaaaauggcugggaggggaugauggacggaugguacggcuuccgccaccagaacagcgagggcaccgggcaggcugccgaucucaagucuacacaagcugccauuaaucagaucaacggaaaacugaauagacuuaucgaaaagaccaacgagaaguuucaucagauugaaaaagaguucgccgaaguggagggccggauccaggaccuggagaaguauguugaagauacaaaaauugaccucugguccuacaaugcugagcugcugguggcgcucgaaaaccaacacaccaucgaucugacggacagcgagaugaacaaacuuuucgaaagaacaaagaagcagcugcgcgagaaugccgaggauauggggaacggaugcuuuaagauuuaucauaaaugugacaaugcuugcaucggcucuauucggaacgggaccuacgaucacgacgucuacagagacgaagcccucaauaaccgcuuccagaucaagggcguggagcugaaauccggauauaaggauuggauccuuuggauuagcuuugccaucuccugcuuccugcucuguauuguucugcugggcuuuaucaugugggcuugccagaaagggaauauucgguguaacaucugcaucuga

SEQ ID NO: 183161 - RNA, 1701 nt, Artificial Sequence
  derived and/or modified sequence opt5 from hemagglutinin__InfluenzaA__AAY28335
augaagaccaucauugcccugagcuacauccucugccugguguccgcucagaaacuucccggcaacgacaauucuacagccacgcugugucucgggcaccaugcggucccuaacggaacccugguuaagacaauuaccaaugaucaaaucgaggugacaaacgcuaccgaacuugugcagagcuccucuacaagcagaauuugcgacuccccgcaccagauccuggauggcgagaauuguacccucaucgacgcccugcugggggauccccauugcgacggauuccagaacaaagaaugggaucucuuugucgagcggucuaaggccuauagcaauuguuacccuuaugacgugcccgauuacguuucccugcgcagccuuguggcuucuuccggcacgcuggaauuuaacaaugagagcuucaacuggaccggggucgcccaaaauggaacaucuuccgcuugcaaaagacggagcgacaagucuuucuuuucccgccucaacuggcugcaccagcuuaaguauaaauacccugcccugaaugugaccaugcccaacaaugagaaguucgauaaacucuauauuuggggcguucaucacccuggcacagacagcgaucagaucucccuguacgcgcaggccucugggagagugaccgucagcacgaagcggucccaacagacagugauuccgaacaucggaagccgccccugggugagaggcgucucuucccggauuagcaucuacuggaccauuguuaaaccuggggacauccugcucaucaacucuacaggaaaucugauugcuccccgcggcuauuuuaagaucagaagcgggaaguccucuauuaugcggagcgacgccccuaucggaaaauguaacuccgaaugcauuacccccaauggcagcaucccgaacgauaagccuuuccagaaugugaaccgcaucaccuacggcgcuugucccagauaugugaaacagaauacacuuaagcuggccacggggaugcggaacgucccugagaaacaaacccgcggaauuuuuggcgcgaucgccggguucauugaaaauggaugggagggcaugauggacgggugguacggauuuagacaccagaacucugagggcacaggccaggcugccgaucucaaguccacccaagcugccaucaaucagauuaacgggaaacugaaucggcuuaucgaaaagacaaacgagaaguuccaucagaucgaaaaagaguuuagcgaaguggagggacgcauucaggaccuggagaaguauguugaagauaccaaaguggaccucuggucuuacaaugccgagcugcuggucgcucucgaaaaccaacacacgaucgaucugacagacuccgagaugaacaaacuuuucgaaagaaccaagaagcagcugcgggagaaugcggaggauaugggcaacgggugcuucaagauuuaucauaaaugugacaaugccugcaucggaagcauuagaaacggcaccuacgaucacgacguguaccgcgacgaagcucucaauaaccgguuucagaucaaggggguugagcugaaauccggcuauaaggauuggauucuuuggaucucuuucgccaucagcugcuuucugcucuguauugugcugcugggauucaucaugugggccugccagaaaggcaauauuagauguaacaucugcauuuga

SEQ ID NO: 183162 - RNA, 1701 nt, Artificial Sequence; identical to SEQ ID NO: 183056
  derived and/or modified sequence opt5 from hemagglutinin__InfluenzaA__AAY28345

SEQ ID NO: 183163 - RNA, 1701 nt, Artificial Sequence; identical to SEQ ID NO: 183096
  derived and/or modified sequence opt5 from hemagglutinin__InfluenzaA__AAY28355

SEQ ID NO: 183164 - RNA, 1701 nt, Artificial Sequence
  derived and/or modified sequence opt5 from hemagglutinin__InfluenzaA__AAY28363
augaagaccaucauugcccugagcuacauccucugcaugguguucgcucagaaacugcccgucaacgacaauuccacagccacgcuuugucugggccaccaugcgguuccuaacgggacccucgugaagacaauuaccaaugaucacaucgaggugacaaacgcuaccgaacugguccaaucuagcuccacaggaagaauuugcgacucuccgcaucagauccuugauggcgagaauuguacccugaucgacgcccuccugggggauccccacugcgacggauuucagaacaaagaaugggaucuguucguggagcggagcacggccuauuccaauuguuacccuuaugacguucccgauuacgcuucucuccgcagccugguggccuccagcggcacccuugaauuuaacaaugagucuuucaacuggacaggggucgcucagaauggaaccuccagcgccugcaagagacggucuauuaaauccuuuuucagccgccugaacuggcuccaucaacugaaguauaaguacccuucucuuaaugugacaaugcccaacaaugagaaauuugacaagcuguauaucuggggcguucaccacccuuccaccgauagcgaccagauuucccucuacgcgcaggccucuggcagagugacggucagcacaaaacggucccagcaaaccgugaucccgaacauugggagccgccccugggugagaggagucucuucccggaucagcauuuacuggacaaucguuaagccuggcgauauccugcugauuaacucuaccgggaaucucaucgcuccccgcggauauuucaaaauuagaagcggcaaguccucuaucaugcggagcaacgccccuauugggaaguguaauuccgaaugcaucacccccaacggaagcaucccgaaugacaaaccuuuucagaacgugaaucgcauuacauacggcgcuugucccagauaugugaagcagaacacgcugaaacuugccaccggcaugcggaaugucccugagaagcagacacgcgggaucuucggagcgauugccggcuuuaucgaaaacgggugggagggaaugguggacggcugguacggguucagacaucaaaauucugagggaaccggccaggcugccgaucugaaauccacacaggcugccauuaaccaaaucaauggcaagcucaaccggcugaucgagaaaaccaaugaaaaguuucaccagauugaaaaggaguucagcgaaguugaggggagaauccaggaccuugagaaauauguggaagauacgaagauugaccuguggucuuacaacgccgagcuccuggucgcucuggaaaaccagcauacaaucgaucucaccgacuccgagaugaauaaacuguucgaacgcacccggaagcaacuuagagagaacgcggaggauaugggaaauggcugcuuuaaaauuuaucacaagugugacaacgccugcaucgggagcauucgcaauggaacauacgaucacgacguguaccgggaugaagcucugaacaauagauuccagaucaagggcguugagcucaaauccggguauaaggacuggauccuguggauuucuuuugccaucagcugcuuccuucugugugugguccuccugggcuuuauuaugugggccugccagaaaggaaacauccgcuguaauauuugcaucuga

SEQ ID NO: 183165 - RNA, 1701 nt, Artificial Sequence; identical to SEQ ID NO: 183096
  derived and/or modified sequence opt5 from hemagglutinin__InfluenzaA__AAY28375

SEQ ID NO: 183166 - RNA, 1701 nt, Artificial Sequence; identical to SEQ ID NO: 183056
  derived and/or modified sequence opt5 from hemagglutinin__InfluenzaA__AAY28385

SEQ ID NO: 183167 - RNA, 1701 nt, Artificial Sequence
  derived and/or modified sequence opt5 from hemagglutinin__InfluenzaA__AAY28395
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuaaccucuacgcgcaggccuccggccgcaucacaguuagcaccaaaagaucccaacagacagugauuccgaacaucgggucucggccccgcgucagagacgugagcucccggauuagcaucuacuggaccaucgugaagccuggagacauucugcugaucaauucuaccggcaaccucauugcuccccgcggguauuucaagaucagauccggaaaaagcucuauuaugcggagcgaugccccuaucggcaaguguaauuccgagugcaucacacccaacggcucuauuccgaaugacaaaccuuuucagaacgucaaucgcaucacguacggggcuugucccagauauauuaagcagaacacccugaaacuugccacaggaaugcggaauguuccugaaaagcaaacccgcggcaucuucggggcgauugccggauuuaucgagaacggcugggaagggaugguggauggaugguacggcuucagacaccagaauagcgagggcacagggcaggcugccgaccugaaauccacccaagcugccaucaaccagauuaauggaaagcucaaccggcugaucggcaagacgaaugagaaauuucaccagauugaaaaggaguucagcgaaguggaggggagaauccaggaucuugaaaaauaugucgaggacacaaagauugaucuguggucuuacaacgccgagcuccugguggcucuggaaaaccaacauaccaucgaccucaccgauuccgagaugaauaaacuguucgaacgcacaaagaagcagcuucgggagaacgcggaagacaugggaaauggcugcuuuaaaauuuaucacaagugugauaacgccugcaucgggagcaucagaaauggcaccuacgaccaugacguuuaccgcgaugaggcucugaacaaucgguuccagauuaaaggaguggagcucaagucuggcuauaaagacuggauccuguggauuuccuuugccaucagcugcuuccuucugugugucgcccuccugggguuuauuaugugggcuugccagaagggaaacaucagauguaauaucugcauuuga

SEQ ID NO: 183168 - RNA, 1701 nt, Artificial Sequence
  derived and/or modified sequence opt5 from hemagglutinin__InfluenzaA__AAY28405
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagauuucuagcacaggcagaaucugcgacaauccgcaccagauccuggauggggagaacuguacccucauugacgcccugcugggagauccccauugcgacggcuuucagaauaaagaaugggaucucuucgucgagcgguccaaggccuauucuaacuguuacccuuaugacgugcccgauuacguuagccugcgcucccuuguggcuucuagcgggacgcuggaauuuaauaacgaguccuucaauuggaccggagucgcccaaaacggcacaagcucugcuugcaaaagacgguccgacaagagcuuuuucucucgccucaauuggcugcaccagcuuaaguauaaauacccugcccugaacgugaccaugcccaauaacgagaaguuugauaaacucuauaucuggggcguucaucacccugggacagacuccgaucagauuagccuguacgcgcaggccucuggaagagugaccgucuccacgaagcggagccaacagacagugaucccgaacauuggcucccgccccugggugagaggggucucuagccggaucuccauuuacuggaccaucguuaaaccuggagacauccugcucauuaauagcacaggcaaccugaucgcuccccgcggguauuucaagauuagaucuggaaaguccagcaucaugcggucugacgccccuauuggcaaauguaauagcgaaugcaucacccccaacggcuccaucccgaaugauaagccuuuucagaacgugaaucgcauuaccuacgggcccuguccuagauaugugaaacagaacacacuuaagcuggcuacgggaaugcggaauguccccgagaaacaaacccgcggcaucuucggggccauugcgggauuuaucgaaaacggcugggaggggaugauggacggaugguacggcuucagacaccaaaauucugagggcacagggcaggccgcugaucucaagagcacccaggccgcuauuaaccagaucaauggaaaacugaaccggcuuaucgaaaagacaaaugagaaguuucaucagauugaaaaagaguucuccgaaguggagggcagaauccaggaccuggagaaguauguugaagauaccaaaauugaccucuggagcuacaacgccgagcugcugguggcccucgaaaaccaacacacgaucgaucugacagacucugagaugaauaaacuuuucgaacgcaccaagaagcagcugcgggagaacgcugaggauauggggaauggaugcuuuaagauuuaucauaaaugugacaacgcgugcaucggcuccauuagaaaugggaccuacgaucacgacgucuaccgcgacgaagcccucaacaaucgguuccagaucaagggcguggagcugaaaagcggauauaaggauuggauccuuuggauuucuuuugcuaucuccugcuuccugcucuguauuguucugcugggcuuuaucaugugggccugccagaaagggaacauuagauguaauaucugcguguga

SEQ ID NO: 183169 - RNA, 1701 nt, Artificial Sequence; identical to SEQ ID NO: 183056
  derived and/or modified sequence opt5 from hemagglutinin__InfluenzaA__AAY28486

SEQ ID NO: 183170 - RNA, 1701 nt, Artificial Sequence; identical to SEQ ID NO: 183056
  derived and/or modified sequence opt5 from hemagglutinin__InfluenzaA__AAY28521

SEQ ID NO: 183171 - RNA, 1701 nt, Artificial Sequence; identical to SEQ ID NO: 183055
  derived and/or modified sequence opt5 from hemagglutinin__InfluenzaA__AAY28531

SEQ ID NO: 183172 - RNA, 1701 nt, Artificial Sequence; identical to SEQ ID NO: 183056
  derived and/or modified sequence opt5 from hemagglutinin__InfluenzaA__AAY28541

SEQ ID NO: 183173 - RNA, 1701 nt, Artificial Sequence
  derived and/or modified sequence opt5 from hemagglutinin__InfluenzaA__AAY28551
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauuggguccggacccugggugcgcggcgucagcucuagaaucuccauuuacuggacaaucguuaagccuggggauauccugcucauuaacagcaccggaaaucugaucgcuccccggggcuauuucaaaauucgcucugggaaaagcuccaucaugagaucuaacgccccuauuggaaaguguaauagcgaaugcaucacccccaacggcuccaucccgaaugacaaaccuuuucagaacgugaaucggauuacauacggcgccuguccccgcuaugugaagcagaacacgcuuaaacuggcgaccgggaugagaaaugucccugagaagcagacacggggaaucuucggcgccauugcuggguuuaucgaaaacggaugggagggcaugguggacgggugguacggauuccgccaucaaaauagcgagggcaccggccaggccgcugaucucaaaucuacacaggccgccauuaaccaaaucaaugggaagcugaacagacuuaucgaaaagaccaaugagaaguuucaccagauugaaaaggaguucuccgaaguugagggacggauccaggaccuggagaaauauguggaagauacgaagauugaccucuggagcuacaacgcugagcugcuggucgcgcucgaaaaccagcauacaaucgaucugaccgacucugagaugaauaaacuuuucgaaagaacccgcaagcaacugcgggagaacgccgaggauaugggcaaugggugcuuuaaaauuuaucacaagugugacaacgcuugcaucggauccauuagaaauggcacauacgaucacgacguguaccgcgaugaagcccucaacaaucgguuccagaucaaggggguugagcugaaaagcggcuauaaggacuggauccuuuggauuuccuuugccaucucuugcuuccugcucugugugguccugcugggauuuauuaugugggcuugccagaaaggcaacaucagauguaauauuugcaucuga

SEQ ID NO: 183174 - RNA, 1701 nt, Artificial Sequence; identical to SEQ ID NO: 183056
  derived and/or modified sequence opt5 from hemagglutinin__InfluenzaA__AAY28561

SEQ ID NO: 183175 - RNA, 1701 nt, Artificial Sequence; identical to SEQ ID NO: 183071
  derived and/or modified sequence opt5 from hemagglutinin__InfluenzaA__AAY28581

SEQ ID NO: 183176 - RNA, 1701 nt, Artificial Sequence
  derived and/or modified sequence opt5 from hemagglutinin__InfluenzaA__AAY28591
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcuggacgugacaaugcccaauaacgagaaauuugauaagcucuauaucuggggcguucaccacccuucuaccgacuccgaucagauuagccuguacgcccaggcuuccggcagagugacggucucuacaaaacggagccagcaaaccgugaucccgaauauugggucccgccccugggugagaggagucagcucucggaucuccauuuacuggacaaucguuaagccuggcgacauccugcucauuaacagcaccgggaaccugaucgcuccccgcggauauuucaaaauuagaucuggcaagagcuccaucaugcggucuaaugccccuauugggaaguguaacagcgaaugcaucacccccaauggauccaucccgaacgacaaaccuuuucagaaugugaaccgcauuacauacggcgccugucccagauaugugaagcagaauacgcuuaaacuggcgaccggcaugcggaacgucccugagaagcagacacgcgggaucuucggagccauugcuggcuuuaucgaaaaugggugggagggaaugguggauggcugguacggguucagacaucaaaacagcgagggaaccggccaggccgcugaccucaaaucuacacaggccgccauuaaucaaaucaacggcaagcugaaucggcuuaucgagaaaaccaacgaaaaguuucaccagauugaaaaggaguucuccgaaguugaggggagaauccaggaucuggagaaauauguggaagacacgaagauugaucucuggagcuacaaugcugagcugcuggucgcgcucgaaaaccagcauacaaucgaccugaccgauucugagaugaacaaacuuuucgaacgcacccggaagcaacugagagagaaugccgaggacaugggaaacggcugcuuuaaaauuuaucacaagugugauaaugcuugcaucggguccauucgcaacggaacauacgaccacgauguguaccgggacgaagcccucaauaacagauuccagaucaagggcguugagcugaaaagcggguauaaggacuggauccuuuggauuuccuuugccaucucuugcuuccugcucugugugguccugcugggcuuuauuaugugggcuugccagaaaggaaauauccgcuguaacauuugcaucuga

SEQ ID NO: 183177 - RNA, 1701 nt, Artificial Sequence; identical to SEQ ID NO: 183096
  derived and/or modified sequence opt5 from hemagglutinin__InfluenzaA__AAY28608

SEQ ID NO: 183178 - RNA, 1701 nt, Artificial Sequence
  derived and/or modified sequence opt5 from hemagglutinin__InfluenzaA__AAY28618
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcaccauccugggacggauucugaccagauuucccucuacgcgcaggccagcggccgcaucacaguuuccaccaaaagaucucaacagacagugauuccgaacaucgggagccggccccgcgucagagauguguccagccggaugucuauuuacuggaccaucgugaagccuggagacauccugcugauuaauuccaccggcaaccucaucgcuccccgcggguauuucaagauuagaagcggaaaaucuagcaucaugcgguccgacgccccuauuggcaaguguaauucugagugcaucacacccaacggcagcaucccgaaugauaaaccuuuucagaacgucaaucgcauuacguacggggcuugucccagauauguuaagcagaacacccugaaacuugccacaggaaugcggaaugugccugaaaagcaaacccgcggcaucuucggggcgauugccggauuuaucgagaacggcugggaagggaugguggacggaugguacggcuucagacaccaaaauuccgagggcacagggcaggcugccgaucugaaaagcacccaggcugccauuaaccagaucaauggaaagcucaaccggcugaucggcaagacgaaugagaaauuucaccagauugaaaaggaguucucugaagucgaggggagaauccaggaccuugaaaaauauguggaggauacaaagauugaccugugguccuacaacgccgagcuccugguugcucuggaaaaccaacauaccaucgaucucaccgacagcgagaugaauaaacuguucgaacgcacaaagaagcagcuucgggagaacgcggaagauaugggaaauggcugcuuuaaaauuuaucacaagugugacaacgccugcaucgagucuauuagaaaugggaccuacgaucaugacguguaccgcgacgaggcucugaacaaucgguuccagaucaaaggcgucgaacucaaguccggauauaaagauuggauccuguggauuagcuuugccaucuccugcuuccuucuguguguggcccuccugggcuuuauuaugugggcuugccagaaggggaacaucagauguaauauuugcaucuga

SEQ ID NO: 183179 - RNA, 1701 nt, Artificial Sequence; identical to SEQ ID NO: 183071
  derived and/or modified sequence opt5 from hemagglutinin__InfluenzaA__AAY28638

SEQ ID NO: 183180 - RNA, 1701 nt, Artificial Sequence
  derived and/or modified sequence opt5 from hemagglutinin__InfluenzaA__AAY28648
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagcgggcccugggugcgcggagucuccagcagaauuucuaucuacuggaccauuguuaaaccuggcgacauccugcucaucaacuccacagggaaucugauugcuccccggggauauuucaagauccgcagcggcaagucuagcauuaugagauccgacgccccuaucggcaaauguaacucugaaugcauuacccccaaugggagcaucccgaacgauaagccuuuucagaaugugaaccggaucaccuacggagcuuguccccgcuaugugaaacagaauacacuuaagcuggccacgggcaugagaaacgucccugagaaacaaacccgggggauuuucggagcgaucgccggcuuuauugaaaaugggugggagggaaugauggacggcugguacggcuuccgccaccagaacuccgaggggacaggacaggcugccgaucucaagagcacccaagcugccaucaaucagauuaacggcaaacugaauagacuuaucgaaaagacaaacgagaaguuucaucagaucgaaaaagaguucucugaaguggaggggcggauucaggaccuggagaaguauguugaagauaccaaaaucgaccucugguccuacaaugccgagcugcugguggcucucgaaaaccaacacacgauugaucugacagacagcgagaugaacaaacuuuucgaaagaaccaagaagcagcugcgcgagaaugcggaggauaugggaaacggcugcuuuaagaucuaucauaaaugugacaaugccugcauugggucuauccggaacggcaccuacgaucacgacgucuacagagacgaagcucucaauaaccgcuuccagauuaagggaguggagcugaaauccggcuauaaggauuggauccuuuggaucagcuuugccauuuccugcuuccugcucuguaucguucugcugggguuuauuaugugggccugccagaaaggaaauauccgguguaacauuugcaucuga

SEQ ID NO: 183181 - RNA, 1701 nt, Artificial Sequence
  derived and/or modified sequence opt5 from hemagglutinin__InfluenzaA__AAY44610
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaaauaaagccuauagcaacuguuacccuuaugacgugcccgauuacgcuucccuccggucucugguugccagcuccggaacgcuugaguuuaauaacgaaucuuucgacuggaccggcgugacacagaauggcaccucuuccgcuugcaagcgcagaagcaacaagagcuuuuucucccggcugaauuggcucacacaucugaaauauaaguacccugcccuuaacgucaccaugcccaauaacgagaaauuugauaagcuguauaucuggggagugcaccauccugggacggacagcgaucagauuucucucuacgcgcaggccuccggccgcaucacaguuagcaccaaaagaucccaacagacagugauuccgaacaucgggucucggccccgcgucagagacgugagcucccggauuagcaucuacuggaccaucgugaagccuggagacauucugcugaucaauucuaccggcaaccucauugcuccccgcggguauuucaagaucagauccggaaaaagcucuauuaugcggagcgaugccccuaucggcaaguguaauuccgagugcaucacacccaacggcucuauuccgaaugacaaaccuuuucagaacgucaaucgcaucacguacggggcuugucccagauauguuaagcagaacacccugaaacuugccacaggaaugcggaaugugccugaaaagcaaacccgcggcauuuucggggcgaucgccggauuuauugagaacggcugggaagggaugguggauggaugguacggcuucagacaccagaauagcgagggcacagggcaggcugccgaccugaaauccacccaagcugccaucaaccagaucaauggaaagcucaaccggcugauuggcaagacgaaugagaaauuucaccagaucgaaaaggaguucagcgaagucgaggggcgcauucaggaucuugaaaaauauguggaggacacaaagaucgaucuguggucuuacaacgccgagcuccugguugcucuggaaaaccaacauaccauugaccucaccgauuccgagaugaauaaacuguucgaaagaacaaagaagcagcuucgggagaacgcggaagacaugggaaauggcugcuuuaaaaucuaucacaagugugauaacgccugcauugggagcaucagaaauggcaccuacgaccaugacguguaccgcgaugaggcucugaacaaucgguuccagaucaaaggagucgagcucaagucuggcuauaaagacuggauucuguggaucuccuuugccauuagcugcuuccuucuguguguggcccuccugggguuuaucaugugggcuugccagaagggaaacauuagauguaauaucugcaucuga

SEQ ID NO: 183182 - RNA, 1701 nt, Artificial Sequence
  derived and/or modified sequence opt5 from hemagglutinin__InfluenzaA__AAY44620
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacuccgagggcacagggcaggccgcugaucucaagagcacccaagccgcuaucaaucagauuaacgaaaaacugaaucggcuuaucgagaagacaaacgaaaaguuucaucagaucgagaaagaguucucugaaguggagggacgcauucaggaccuggaaaaguauguugaggauaccaaaaucgaccucugguccuacaaugccgaacugcugguggcccucgagaaccaacacacgauugaucugacagacagcgaaaugaacaaacuuuucgagagaaccaagaagcagcugcgggagaaugcugaagauaugggcaacgggugcuuuaagaucuaucauaaaugugacaaugcgugcauuggaucuaucagaaacggcaccuacgaucacgacgucuaccgcgacgaggcccucaauaaccgguuccagauuaaggggguggaacugaaauccggcuauaaggauuggauccuuuggaucagcuuugcuauuuccugcuuccugcucuguaucguucugcugggauuuauuaugugggccugccagaaaggcaauaucagauguaacauuugcaucuga

SEQ ID NO: 183183 - RNA, 1701 nt, Artificial Sequence; identical to SEQ ID NO: 183104
  derived and/or modified sequence opt5 from hemagglutinin__InfluenzaA__AAY44621

SEQ ID NO: 183184 - RNA, 1701 nt, Artificial Sequence; identical to SEQ ID NO: 183071
  derived and/or modified sequence opt5 from hemagglutinin__InfluenzaA__AAY44631

SEQ ID NO: 183185 - RNA, 1701 nt, Artificial Sequence
  derived and/or modified sequence opt5 from hemagglutinin__InfluenzaA__AAY44641
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacuccgagggcacagggcaggccgcugaucucaagagcacccaagccgcuaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcccucgaaaaccaacacacgauugaucugacagacagcgagaugaacaaacuuuucgaaagaaccaagaagcagcugcgggagaaugcugaggauauggggaacggaugcuuuaagaucuaucauaaaugugacaaugcgugcauuggcucuaucagaaacgggaccuacgaucacgacgucuaccgcgacgaagcccucaauaaccgguuccagauuaagggcguggagcugaaauccggauauaaggauuggauccuuuggaucagcuuugcuauuuccugcuuccugcucuguaucggccugcugggguuuauuaugugggccugccagaaaggaaauaucagauguaacauuugcaucuga

SEQ ID NO: 183186 - RNA, 1701 nt, Artificial Sequence
  derived and/or modified sequence opt5 from hemagglutinin__InfluenzaA__AAY44651
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggaaagaggagugagcucucggaucuccauuuacuggacaaucgucaagccuggcgauauccugcucauuaacagcaccgggaaucugaucgcuccccgcggauauuucaaaauuagaucuggcaagagcuccaucaugcggucuaacgccccuauugggaaguguaauagcgagugcaucacccccaacggauccaucccgaaugacaaaccuuuucagaacguuaaucgcauuacauacggcgccugucccagauaugugaagcagaacacgcuuaaacuggcgaccggcaugcggaaugugccugaaaagcagacacgcgggaucuucggagccauugcuggcuuuaucgagaacgggugggagggaauggucgacggcugguacggguucagacaucaaaauagcgaaggaaccggccaggccgcugaucucaaaucuacacaggccgccauuaaccaaaucaauggcaagcugaaccggcuuaucgagaaaaccaaugaaaaguuucaccagauugagaaggaguucuccgaaguggaggggagaauccaggaccuggaaaaauauguugaggauacgaagauugaccucuggagcuacaacgcugaacugcugguggcgcucgagaaccagcauacaaucgaucugaccgacucugaaaugaauaaacuuuucgagcgcacccggaagcaacugaaagagaacgccgaagauaugggaaauggcugcuuuaagauuuaucacaagugugacaacgcuugcaucggguccauuagaaauggaacauacgaucacgacgucuaccgcgaugaggcccucaacaaucgguuccagaucaaaggcguggaacuuaagagcggguauaaagacuggauccuguggauuuccuuugccaucucuugcuuccugcucuguguugugcugcugggcuuuauuaugugggcuugccagaagggaaacaucagauguaauauuugcaucuga

SEQ ID NO: 183187 - RNA, 1701 nt, Artificial Sequence
  derived and/or modified sequence opt5 from hemagglutinin__InfluenzaA__AAY44755
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggggacaacagacagucauuccgaacaucggcagccgccccugggugagagggguguccagcauuaucucuauuuacuggaccaucgucaaaccuggagauauccugcucauuaauuccacaggcaaccugaucgcuccccggggguauuucaagauucgcagcggaaagucuagcguuaugagauccgacgccucuaucggcaaauguaauagcgaaugcauuaccccuaacggcuccauccccaaugacaagccguuucagaacgugaaucggaucaccuacggggccuguccucgcuaugugaaacagaacacacuuaagcuggcgacgggaaugagaaauguccccgagaaacaaacccggggcauuuucggggccaucgcuggauuuauugaaaacggcugggaggggaugguggauggaugguacggcuuccgccaccagaauagcgagggcacagggcaggccgcugaccucaagucuacccaagccgccaucaaccagauuaauggaaaacugaacagacuuaucgaaaagacaaaugagaaguuucaucagaucgaaaaagaguucuccgaaguugagggccggauucaggaucuggagaaguauguggaagacaccaaaaucgaucucuggagcuacaacgcugagcugcuggucgcgcucgaaaaccaacacacgauugaccugacagauucugagaugaauaaacuuuucgaaagaaccaagaagcagcugcgcgagaacgccgaggacauggggaauggaugcuuuaagaucuaucauaaaugugauaacgcuugcauuggcuccauccggaaugggaccuacgaccacgauguguacagagacgaagcccucaacaaucgcuuccagauuaagggcguugagcugaaaagcggauauaaggacuggauccuuuggaucuccuuugccauuucuugcuuccugcucugugugguccugcugggcuuuaucaugugggcuugccagaaagggaacauucgguguaauaucugcauuuga

SEQ ID NO: 183188 - RNA, 1701 nt, Artificial Sequence
  derived and/or modified sequence opt5 from hemagglutinin__InfluenzaA__AAY44775
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucaggauaaagaaugggaccucuucguggagcggagcacggccuauuccaacuguuacccuuaugauguucccgacuacgcuucucugcgcagccuuguggccuccagcggcacccuggaauuuaauaacgagucuuucaauuggacaggggucgcucagaacggaaccuccagcgccugcaagagacggucuauuaaauccuuuuucagccgccucaauuggcugcaucaacuuaaguauaaguacccugcgcugaacgugacaaugcccaauaacgagaaauuugauaagcucuauaucuggggcguucaccacccuucuaccgacuccgaucagauuagccuguacgcccaggcuuccggcagagugacggucucuacaaaacggagccagcaaaccgugaucccgaauauugggucccgccccugggugagaggagucagcucucggaucuccauuuacuggacaaucguuaagccuggcgacauccugcucauuaacagcaccgggaaccugaucgcuccccgcggauauuucaaaauuagaucuggcaagagcuccaucaugcggucuaaugccccuauugggaaguguaacagcgaaugcaucacccccaauggauccaucccgaacgacaaaccuuuucagaaugugaaccgcauuacauacggcgccugucccagauaugugaagcagacgacccuuaaacuggcgacaggcaugcggaaugucccugagaagcagacccgcgggaucuucggagccauugcuggcuuuaucgaaaacgggugggagggaaugguggauggcugguacggguucagacaucaaaauagcgagggaacaggccaggccgcugaccucaaaucuacccaggccgccauuaaccaaaucaauggcaagcugaaccggcuuaucgagaaaacgaaugaaaaguuucaccagauugaaaaggaguucuccgaaguugaggggagaauccaggaucuggagaaauauguggaagacacaaagauugaucucuggagcuacaacgcugagcugcuggucgcgcucgaaaaucagcauaccaucgaccugaccgauucugagaugaacaaacuuuucgaacgcacacggaagcaacugagagagaacgccgaggacaugggaaauggcugcuuuaaaauuuaucacaagugugauaacgcuugcaucggguccauucgcaauggaaccuacgaccacgauguguaccgggacgaagcccucaacaauagauuccagaucaagggcguugagcugaaaagcggguauaaggacuggauccuuuggauuuccuuugccaucucuugcuuccugcucugugugguccugcugggcuuuauuaugugggcuugccagaaaggaaacauccgcuguaauauuugcaucuga

SEQ ID NO: 183189 - RNA, 1701 nt, Artificial Sequence; identical to SEQ ID NO: 183096
  derived and/or modified sequence opt5 from hemagglutinin__InfluenzaA__AAY44785

SEQ ID NO: 183190 - RNA, 1701 nt, Artificial Sequence
  derived and/or modified sequence opt5 from hemagglutinin__InfluenzaA__AAY44795
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuacccaucagauccuggauggcgagaauuguacgcucaucgacgcccugcugggggauccgcacugcgacggauuucagaacaaagaaugggaucucuucguggagcggagcaccgccuauuccaauuguuaccccuaugacguuccugauuacgcuucucugcgcagccuuguggccuccagcggcacacuggaauuuaacaaugagucuuucaacuggaccggggucgcucagaauggaacauccagcgccugcaagagacggucuauuaaauccuuuuucagccgccucaacuggcugcaucaacuuaaguauaaguaccccgcgcugaaugugaccaugccuaacaaugagaaauuugacaagcucuauaucuggggcguucaccaccccucuacggauuccgaccagauuagccuguacgcccaggcuuccggcagagugacagucucuaccaaacggagccagcaaacagugaucccuaacauugggucccgcccgugggugagaggagucagcucucggaucuccauuuacuggaccaucguuaagcccggcgauauccugcucauuaacagcaccgggaaucugaucgccccucgcggauauuucaaaauuagaucuggcaagagcuccaucaugcggucuaacgcucccauugggaaguguaauagcgaaugcaucacaccuaacggauccauccccaaugacaaaccguuucagaacgugaaucgcauuacguacggcgccuguccuagauaugugaagcagaacacccuuaaacuggcgacaggcaugcggaauguccccgagaagcagacccgcgggaucuucggagccauugcuggcuuuaucgaaaacgggugggagggaaugguggacggcugguacggguucagacaucaaaauagcgagggaacaggccaggccgcugaucucaaaucuacccaggccgccauuaaccaaaucaauggcaagcugaaccggcuuaucgagaaaacgaaugaaaaguuucaccagauugaaaaggaguucuccgaaguugaggggagaauccaggaccuggagaaauauguggaagauacaaagauugaccucuggagcuacaacgcugagcugcuggucgcgcucgaaaaccagcauaccaucgaucugaccgacucugagaugaauaaacuuuucgaacgcacacggaagcaacugagagagaacgccgaggauaugggaaauggcugcuuuaaaauuuaucacaagugugacaacgcuugcaucggguccauucgcaauggaaccuacgaucacgacguguaccgggaugaagcccucaacaauagauuccagaucaagggcguugagcugaaaagcggguauaaggacuggauccuuuggauuuccuuugccaucucuugcuuccugcucugugugguccugcugggcuuuauuaugugggcuugccagaaaggaaacauccgcuguaauauuugcaucuga

SEQ ID NO: 183191 - RNA, 1701 nt, Artificial Sequence
  derived and/or modified sequence opt5 from hemagglutinin__InfluenzaA__AAY44796
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgggauuugcgacucuccgcaccagauccuugauggagagaauuguacgcugaucgacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacccuugaguuuaacaaugaaucuuucgacuggacaggcgugacccagaacggcacauccagcgcuugcaagcgcagaucuaauaaguccuuuuucagccggcugaacuggcucacccaucugaaauauaaguacccugcccuuaaugucacgaugcccaacaaugagaaauuugauaagcuguauauuuggggagugcaccauccugggacagacucugaucagaucucccucuacgcgcaggccagcggccgcauuaccguuuccacaaaaagaucucaacagaccgugaucccgaacauugggagccggccccgcgucagagacguguccagccggaucucuauuuacuggaccaucgugaagccuggagacauccugcugauuaacuccacaggcaaucucaucgcuccccgcggguauuucaagauuagaagcggaaaaucuagcaucaugcgguccgaugccccuauuggcaaguguaacucugagugcaucacgcccaauggcagcaucccgaacgacaaaccuuuucagaaugucaaccgcauuaccuacggggcuugucccagauauaucaagcagaauacacugaaacuugccaccggaaugcggaacguuccugaaaagcaaacacgcggcauuuucggggcgaucgccggauuuauugagaauggcugggaagggaugguggauggaugguacggcuucagacaccagaacuccgagggcaccgggcaggcugccgaccugaaaagcacgcaagcugccaucaaucagaucaacggaaagcucaaucggcugauuggcaagacaaacgagaaauuucaccagaucgaaaaggaguucucugaaguggaggggcgcauucaggaucuugaaaaauaugucgaggacaccaagaucgaucugugguccuacaaugccgagcuccugguggcucuggaaaaccaacauaccauugaccucacagauagcgagaugaacaaacuguucgaaagaaccaagaagcagcuucgggagaaugcggaagacaugggaaacggcugcuuuaaaaucuaucacaagugugauaaugccugcauugggucuaucagaaacggcacauacgaccaugacguuuaccgcgaugaggcucugaauaaccgguuccagaucaaaggaguggagcucaaguccggcuauaaagacuggauucuguggaucagcuuugccauuuccugcuuccuucugugugucgcccuccugggguuuaucaugugggcuugccagaagggaaauauuagauguaacaucugcaucuga

SEQ ID NO: 183192 - RNA, 1701 nt, Artificial Sequence; identical to SEQ ID NO: 183071
  derived and/or modified sequence opt5 from hemagglutinin__InfluenzaA__AAY44896

SEQ ID NO: 183193 - RNA, 1701 nt, Artificial Sequence
  derived and/or modified sequence opt5 from hemagglutinin__InfluenzaA__AAY44906
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaacgccaaaccagaggcauuuucggggcgaucgccggauuuauugagaauggcugggaagggaugguggauggaugguacggcuuccggcaccagaacuccgagggcacagggcaggcugccgaccugaaaagcacccaagcugccaucaaucagaucaacggaaaacucaauagacugauuggcaagacgaacgagaaguuucaccagaucgaaaaagaguucucugaagucgaggggcgcauucaggaucuugaaaaguauguggaggacacaaaaaucgaucugugguccuacaaugccgagcuccugguugcucuggaaaaccaacauaccauugaccucaccgauagcgagaugaacaagcuguucgaacggacaaagaagcagcuuagagagaaugcggaagacaugggaaacggcugcuuuaagaucuaucacaaaugugauaaugccugcauugggucuauccgcaacggcaccuacgaccaugacguguaccgggaugaggcucugaauaacagauuccagaucaagggagucgagcucaaauccggcuauaaggacuggauucuguggaucagcuuugccauuuccugcuuccuucuguguguggcccuccugggguuuaucaugugggcuugccagaaaggaaauauucgcuguaacaucugcaucuga

SEQ ID NO: 183194 - RNA, 1701 nt, Artificial Sequence
  derived and/or modified sequence opt5 from hemagglutinin__InfluenzaA__AAY46371
augaagaccaucauugcccugagcuacauccucugccugguguucgcucagaaacuucccggcaacgacaauuccacagccacgcugugucucgggcaccaugcggucccuaacggaacccugguuaagacaauuaccucugaucaaaucgaggugacaaaugcuaccgaacuugugcagagcuccucuacaggcagaauuugcgacagcccgcaccggauccuggauggggagaacuguacccucaucgacgcccugcugggagauccccauugcgacggcuuucagaauaaagaaugggaucucuucgucgagcgcuccaaggccuauucuaacuguuacccuuaugacgugcccgauuacgcuagccugagaucccuuguugccagcucugggacgcuggaauuuaauaacgaguccuucaauuggaccggaguggcucagaacggcaccagcuuugccugcaaacggcgcucuauuaaguccuucuuuagcagacucaauuggcugcaccaacuuaaguauaaauacccugcgcugaacgucacaaugcccaauaacgacaaguucgauaaacucuauaucuggggcgugcaucacccugggacagacucugaucagaccucccuguacgcccaggcuagcggacggguuacgguguccacaaagcgcucucagcaaaccgucauuccgaauaucggcagcagacccugggugcgcgggguguccagccggauuucuaucuacuggacaauugucaaaccuggagacauccugcucaucaacuccaccggcaaccugauugcccccagaggguauuuuaagauccggagcggaaagucuagcauuaugcgcuccgacgcuccuaucggcaaauguaauucugagugcauuacccccaacggcagcaucccgaaugggaagccuuuccagaacguuaauagaaucacauacggagccuguccccgguaugugaaacagaacacgcuuaagcuggcgaccggcaugcgcaaugugccugaaaaacagacaagagggauuuuuggagccaucgcuggcuucauugagaacgggugggaaggaauggucgauggcugguacggcuuucggcaccaaaauuccgaggggaccggacaggccgcugaccucaagagcacacaggccgccaucaaccaaauuaauggcaaacugaacagacuuaucgagaagaccaaugaaaaguuccaucagaucgagaaagaguucacggaaguggaagggcgcauucaggaucuggagaaguauguugaggacacaaaaaucgaucucuggucuuacaacgcugaacugcugguggcgcucgagaaucagcacaccauugaccugaccgauuccgaaaugaacaaacuuuuugagcggacaagaaagcaacugcgcgaaaacgccgaggacaugggaaauggcugcuucaagaucuaucauaagugugauaacgcuugcauugggagcauccggaauggcaccuacgaccacgaugucuacagagacgaggcccucaacaaucgcuuucagauuaaaggaguggaacugaagucuggcuauaaagacuggauccuuuggaucuccuucgccacaagcugcuuucugcucuguguugugcugcugggguucauuaugugggcuugccagaagggaaacauccgguguaauauuugcaucuga

SEQ ID NO: 183195 - RNA, 1701 nt, Artificial Sequence; identical to SEQ ID NO: 183056
  derived and/or modified sequence opt5 from hemagglutinin__InfluenzaA__AAY46381

SEQ ID NO: 183196 - RNA, 1701 nt, Artificial Sequence
  derived and/or modified sequence opt5 from hemagglutinin__InfluenzaA__AAY46391
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucuaucauuuccaucuacuggacaaucguuaagccuggcgauauucugcucaucaacagcaccgggaaucugauugcuccccggggauauuucaaaauccgcucuggcaagagcuccauuaugagaucuaacgccccuaucgggaaguguaauagcgaaugcaucacccccaacggauccauuccgaaugacaaaccuuuucagaacgugaaucggaucacauacggcgccuguccccgcuaugugaagcagaacacgcuuaaacuggcgaccggcaugagaaaugucccugagaagcagacacgggggauuuucggagccaucgcuggcuuuauugaaaacgggugggagggaaugguggacggcugguacggguuccgccaucaaaauagcgagggaaccggccaggccgcugaucucaaaucuacacaggccgccaucaaccaaaucaauggcaagcugaacagacuuauugagaaaaccaaugaaaaguuucaccagaucgaaaaggaguucuccgaaguugaggggcggauucaggaccuggagaaauauguggaagauacgaagaucgaccucuggagcuacaacgcugagcugcuggucgcgcucgaaaaccagcauacaauugaucugaccgacucugagaugaauaaacuuuucgaaagaacccgcaagcaacugcgggagaacgccgaggauaugggaaauggcugcuuuaaaaucuaucacaagugugacaacgcuugcauuggguccaucagaaauggaacauacgaucacgacguguaccgcgaugaagcccucaacaaucgguuccagaucaagggcguugagcugaaaagcggguauaaggacuggauucuuuggaucuccuuugccauuucuugcuuccugcucugugugguccugcugggcuuuaucaugugggcuugccagaaaggaaacauuagauguaauaucugcaucuga

SEQ ID NO: 183197 - RNA, 1701 nt, Artificial Sequence
  derived and/or modified sequence opt5 from hemagglutinin__InfluenzaA__AAY46426
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacaagaaauuugacaagcucuauauuuggggcgugcaucacccuucuacagauuccgaccagaucagccuguacgcccaggcuuccgggagaguuaccgugucuacgaaacggagccaacagacagucauuccgaacaucggaucccgccccugggugagaggcgugagcucucggauuuccaucuacuggaccauugucaagccuggggauauccugcucaucaauagcacaggaaaccugauugcuccccgcggcuauuucaagaucagaucugggaaaagcuccauuaugcggucugacgccccuaucggaaaguguaauagcgagugcauuacccccaacggcuccaucccgaaugacaaaccuuuucagaacguuaaucgcaucaccuacggcgccugucccagauaugugaagcagaacacacuuaaacuggcgacggggaugcggaauauuccugaaaagcaaacccgcggaaucuucggcgccauugcuggguuuaucgagaacggaugggaaggcaugguggaugggugguacggauucagacaccagaauagcgagggcacaggccaggccgcugaccucaaaucuacccaagccgccauuaaccagaucaaugggaagcugaaccggcuuaucgagaagacaaaugaaaaauuucaucagauugagaaggaguucuccgaagucgaaggaagaauccaggaucuggagaaauauguggaggacaccaagauugaucucuggagcuacaacgcugaacugcugguugcgcucgagaaccaacacacgaucgaccugacagauucugaaaugaauaaacuuuucgagcgcaccaagaagcagcugcgggaaaacgccgaggacaugggcaaugggugcuuuaaaauuuaucauaagugugauaacgcuugcaucggauccauuagaaauggcaccuacgaccacgauguguaccgcgacgaggcccucaacaaucgguuccagaucaaaggggucgaacuuaagagcggcuauaaagacuggauccuguggauuuccuuugccaucucuugcuuccugcucugugugguucugcugggauuuauuaugugggcuugccagaagggcaacaucagauguaauauuugcaucuga

SEQ ID NO: 183198 - RNA, 1701 nt, Artificial Sequence
  derived and/or modified sequence opt5 from hemagglutinin__InfluenzaA__AAY47013
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagcgggcccugggugcgcggagucuccagcagaauuucuaucuacuggaccauuguuaaaccuggcgacauccugcucaucaacuccacagggaaucugauugcuccccggggauauuucaagauccgcagcggcaagucuagcauuaugagauccgacgccccuaucggcaaauguaacucugaaugcauuacccccaaugggagcaucccgaacgauaagccuuuucagaaugugaaccggaucaccuacggacccuguccucgcuaugugaaacagaauacacuuaagcuggcuacgggcaugagaaacguccccgagaaacaaacccgggggauuuucggagccaucgcgggcuuuauugaaaaugggugggagggaaugauggacggcugguacggcuuccgccaccagaacuccgaggggacaggacaggccgcugaucucaagagcacccaagccgcuaucaaucagauuaacggcaaacugaauagacuuaucaagaagacaaacgaaaaauuucaucagaucgagaaggaguucucugaaguggaagggcggauucaggaccuggagaaauauguugaggauaccaagaucgaccucugguccuacaaugccgaacugcugguggcccucgagaaccaacacacgauugaucugacagacagcgaaaugaacaaacuuuucgagagaaccaagaagcagcugcgcgaaaaugcugaggauaugggaaacggcugcuuuaaaaucuaucauaagugugacaaugcgugcauugggucuauccggaacggcaccuacgaucacgacgucuacagagacgaggcccucaauaaccgcuuccagauuaaaggaguggaacugaaguccggcuauaaagauuggauccuuuggaucagcuuugcuauuuccugcuuccugcucuguaucguucugcugggguuuauuaugugggccugccagaagggaaauauccgguguaacauuugcaucuga
